US012221465B2

(12) United States Patent
Joglekar et al.

(10) Patent No.: US 12,221,465 B2
(45) Date of Patent: Feb. 11, 2025

(54) SIGNALING AND ANTIGEN-PRESENTING BIFUNCTIONAL RECEPTORS (SABR)

(71) Applicant: California Institute of Technology, Pasadena, CA (US)

(72) Inventors: Alok V Joglekar, Pasadena, CA (US); Michael T Leonard, Pasadena, CA (US); Michael T Bethune, Pasadena, CA (US); David Baltimore, Pasadena, CA (US)

(73) Assignee: California Institute of Technology, Pasadena, CA (US)

( * ) Notice: Subject to any disclaimer, the term of this patent is extended or adjusted under 35 U.S.C. 154(b) by 461 days.

(21) Appl. No.: 16/122,562

(22) Filed: Sep. 5, 2018

(65) Prior Publication Data
US 2019/0201443 A1    Jul. 4, 2019

Related U.S. Application Data

(60) Provisional application No. 62/554,652, filed on Sep. 6, 2017.

(51) Int. Cl.
*C07K 14/705*    (2006.01)
*A61K 39/00*    (2006.01)
(Continued)

(52) U.S. Cl.
CPC ...... *C07K 14/7051* (2013.01); *A61K 39/4611* (2023.05); *A61K 39/4615* (2023.05); *A61K 39/4621* (2023.05); *A61K 39/4622* (2023.05); *A61K 39/4632* (2023.05); *A61K 39/46433* (2023.05); *A61K 39/464401* (2023.05); *A61K 39/464488* (2023.05);
(Continued)

(58) Field of Classification Search
None
See application file for complete search history.

(56) References Cited

U.S. PATENT DOCUMENTS 6,491,908 B1    12/2002    Rosenberg
7,319,143 B2 †    1/2008    Gross
(Continued)

FOREIGN PATENT DOCUMENTS

WO    WO 01/91698 A2    12/2001
WO    WO 01/91698 A3    12/2001
(Continued)

OTHER PUBLICATIONS

HLA Nomenclature (2015) (Year: 2015).*
(Continued)

*Primary Examiner* — Michael Szperka
*Assistant Examiner* — Marianne Dibrino
(74) *Attorney, Agent, or Firm* — KNOBBE, MARTENS, OLSON & BEAR, LLP

(57) ABSTRACT

Described herein are compositions and methods for signaling and antigen-presenting bifunctional receptors (SABRs) comprising one or more antigen presenting domains; and one or more signal transduction domains, wherein the one or more antigen presenting domains comprise a binding fragment of a major histocompatibility complex (MHC) molecule. Various immunological functions of the SABRs are also described.

10 Claims, 55 Drawing Sheets

Specification includes a Sequence Listing.

(51) Int. Cl.
   *A61P 37/00* (2006.01)
   *C07K 14/725* (2006.01)
   *C07K 14/74* (2006.01)
   *C12N 5/0783* (2010.01)
   *C40B 40/02* (2006.01)
   *G01N 33/566* (2006.01)
   *G01N 33/68* (2006.01)
   *A61K 38/00* (2006.01)

(52) U.S. Cl.
   CPC .......... *A61K 39/464491* (2023.05); *A61K 39/464838* (2023.05); *A61P 37/00* (2018.01); *C07K 14/705* (2013.01); *C07K 14/70539* (2013.01); *C12N 5/0636* (2013.01); *C40B 40/02* (2013.01); *G01N 33/566* (2013.01); *G01N 33/68* (2013.01); *A61K 38/00* (2013.01); *C07K 2319/03* (2013.01); *C07K 2319/70* (2013.01); *G01N 2333/7051* (2013.01)

(56) References Cited

U.S. PATENT DOCUMENTS

| | | |
|---|---|---|
| 2004/0137562 A1 | 7/2004 | Gross et al. |
| 2007/0066802 A1 † | 3/2007 | Geiger |
| 2015/0139943 A1 * | 5/2015 | Campana .......... C07K 14/70535 424/85.2 |

FOREIGN PATENT DOCUMENTS

| | | |
|---|---|---|
| WO | WO 2014/127261 | 8/2014 |
| WO | WO 2016/097334 A1 | 6/2016 |
| WO | WO 2016/168773 | 10/2016 |
| WO | WO 2017/070608 | 4/2017 |
| WO | WO 201717332 | * 10/2017 |

OTHER PUBLICATIONS

Liu et al.(MHC Complex: Interaction with Peptides. In: eLS. John Wiley & Sons, Ltd: Chichester, DOI: 10.1002/9780470015902. a0000922.pub2, 2011, pp. 1-12) (Year: 2011).*
Wieczorek et al (Front. Immunol. 2017, vol. 8, article 292: 1-16) (Year: 2017).*
Ali-Khan et al.(Current Protocols in Protein Science, 2002: 22.1.-22.1.19) (Year: 2002).*
Schumacher and Schrieber (Science, 2015, 384 (6230): 69-74) (Year: 2015).*
Celis et al.(PNAS USA, 1994, 91: 2105-2109) (Year: 1994).*
Ochoa-Garay et al.(Mol. Immunol. 1997, 34(3): 273-281) (Year: 1997).*
Shen et al (J. Immunol. 2008, 180: 3601-3611). (Year: 2008).*
Novellino et al (Cancer Immunol. Immunother. 2005, 54: 187-207) (Year: 2005).*
Jackaman et al (Cancer Immunol. Immunother., 2012, 61: 2343-2356) (Year: 2012).*
Ennis et al (Virology, 1999, 259: 256-261) (Year: 1999).*
Aarnoudse et al (Int. J. Cancer, 2002, 99: 7-13) (Year: 2002).*
Hutloff et al (Nature, 1999, 397: 263-266) (Year: 1999).*
Rudolf et al (Clin. Cancer Res., Mar. 2001; 7(3 Suppl): 788s-795s, abstract) (Year: 2001).*
Extended European Search Report and Written Opinion in corresponding European Patent Application No. 18854825.9, dated Mar. 31, 2021 in 9 pages.

Moisini et al., "Redirecting Therapeutic T Cells against Myelin-Specific T Lymphocytes Using a Humanized Myelin Basic Protein-HLA-DR2-3 Chimeric Receptor", The Journal of Immunology, Feb. 21, 2008, vol. 180, No. 5, pp. 3601-3611.
Jyothi et al., "Targeting autoantigen-specific T cells and suppression of autoimmuneencephalomyelitis with receptor-modified T lymphocytes", Nature Biotechnology, Nov. 11, 2002, vol. 20, No. 12, pp. 1215-1220.
Joglekar et al., "T cell antigen discovery via signaling and antigen-presenting bifunctional receptors", Nature Methods, Jan. 28, 2019, vol. 16, No. 2, pp. 191-198.
Nguyen et al., "Identification of a murine CD28 dileucine motif that suppresses single-chain chimeric T-cell receptor expression and function", Blood, Dec. 15, 2003, vol. 102, No. 13, pp. 4320-4325.
Geiger et al., "The TCR ζ-Chain Immunoreceptor Tyrosine-Based Activation Motifs AreSufficient for the Activation and Differentiation of Primary T Lymphocytes", The Journal Of Immunology, Jan. 1, 1999, vol. 162, pp. 5931-5939.
Nguyen et al., "Antigen specific targeting of CD8+ T cells with receptor-modified T lymphocytes", Gene Therapy, Apr. 1, 2003, vol. 10, No. 7, pp. 594-604.
Geiger et al., "Integrated src kinase and costimulatory activity enhances signal transduction through single-chain chimeric receptors in T lymphocytes", Blood, Jan. 15, 2001, vol. 98, No. 8, pp. 2364-2371.
Cole, D. K. et al., "T-cell receptor (TCR)-peptide specificity overridesaffinity-enhancing TCR-major histocompatibility complex interactions", The Journal of Biological Chemistry, Jan. 10, 2014, vol. 289, No. 2, pp. 628-638.
Reiser, J.-B. et al., "Analysis of relationships between peptide/MHCstructural features and naive T cell frequency in humans", The Journal of Immunology, 2014, vol. 193, pp. 5816-5826.
International Search Report of PCT/US2018/049622 dated Dec. 28, 2018 in 5 pages.
Written Opinion of PCT/US2018/049622 dated Dec. 28, 2018 in 7 pages.
Office Action for CN 201880071856.4, issued Nov. 2, 2022, 15 pages.
Office Action for JP 2020-513554, issued Nov. 22, 2022, 14 pages.
Office Action issued in JP 2020-513554 issued Apr. 25, 2023, 10 pages.
Office Action issued in CN 201880071856.4 issued Sep. 16, 2023, 14 pages.
Office Action issued in CN 201880071856.4 issued Dec. 21, 2023, 14 pages.
Zhang, Tong et al., "SING: a novel strategy for identifying tumor-specific, CTL-recognized tumor antigens" The FASEB Journal, Mar. 2004, pp. 600-602, vol. 18, Issue 3.
Office Action for JP 2020-513554 issued May 17, 2022, 13 pages.
Geiger et al., Integrated src kinase and costimulatory activity enhances signal transduction through single-chain chimeric receptors in T lymphocytes, Blood, 2001, 98:2364-2371.†
Jyothi et al., Targeting autoantigen-specific T cells and suppression of autoimmune 2 encephalomyelitis with receptor-modified T lymphocytes, Nat. Biotechnol., 2002, 20:1215-1220.†
Nguyen P. and Geiger T.L., Antigen-specific targeting of CD8+ T cells with receptor-modified T lymphocytes, Gene Therapy, 2003, 10:594-604.†
Margalit et al., Chimeric β2 microglobulin/CD3ζ polypeptides expressed in T cells convert MHC class I peptide ligands into T cell activation receptors: a potential tool for specific targeting of pathogenic CD8+ T cells, International Immunology, 2003, 15(11):1379-1387.†

* cited by examiner
† cited by third party

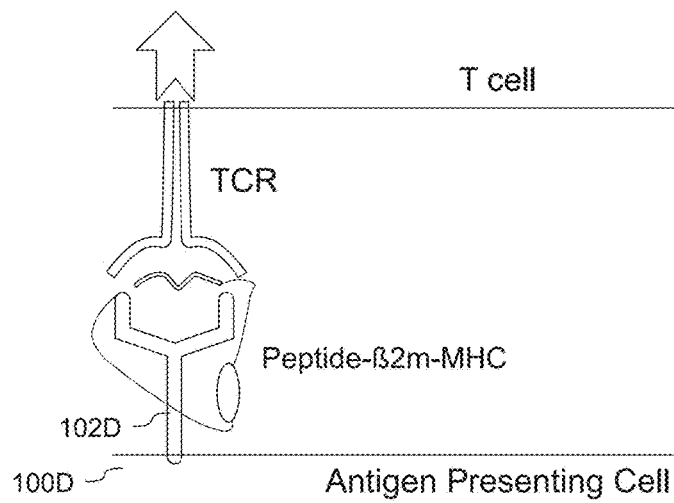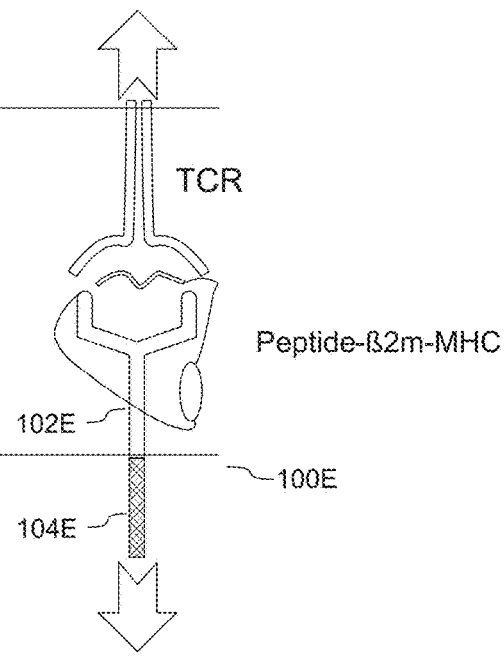

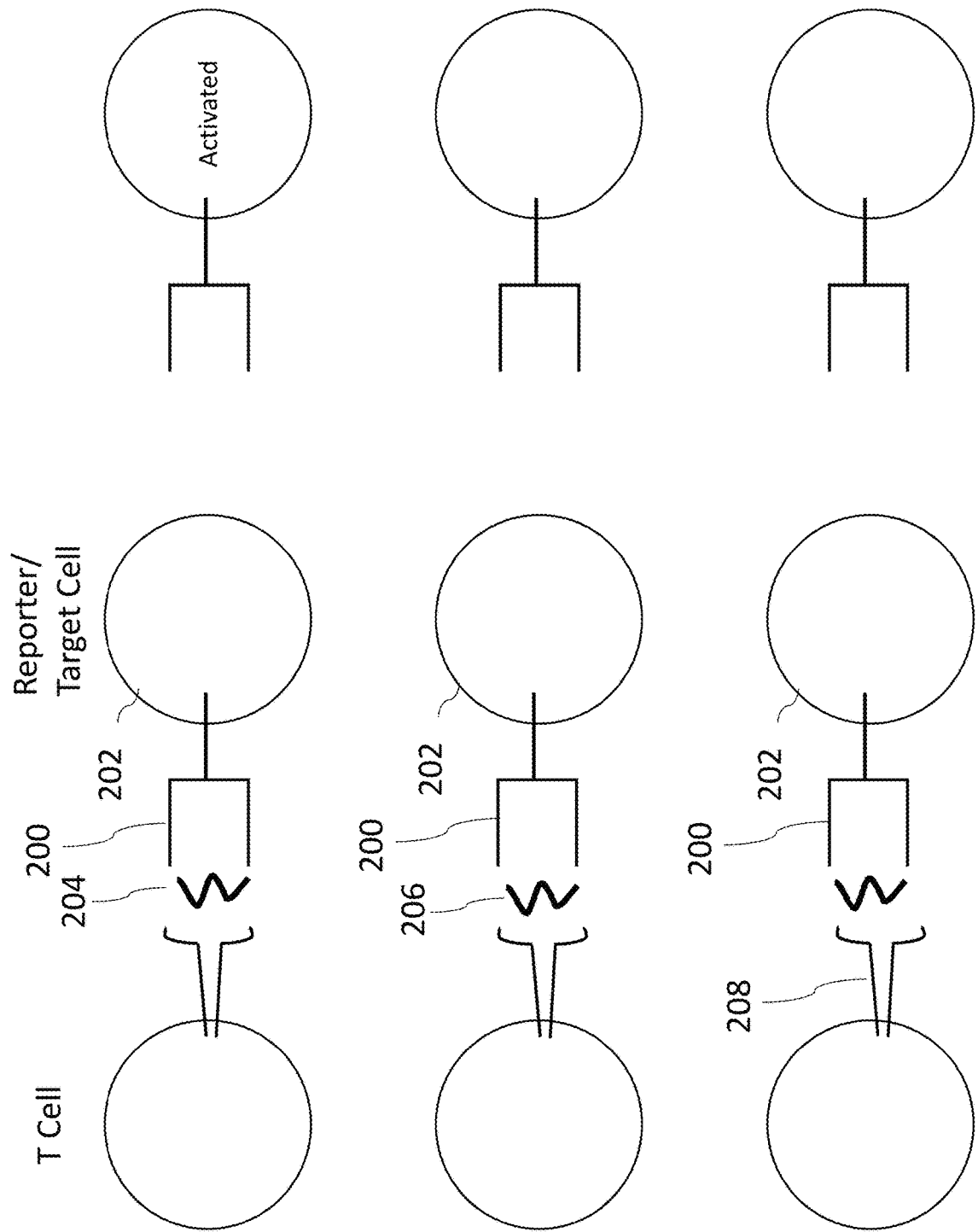

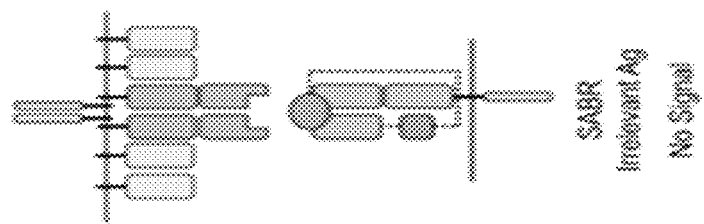
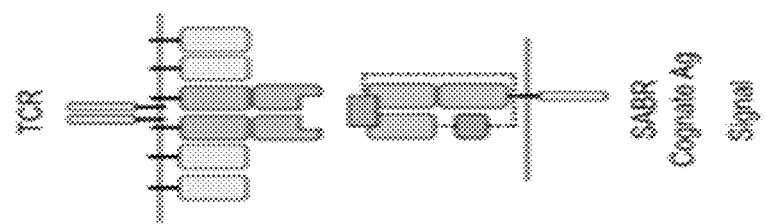
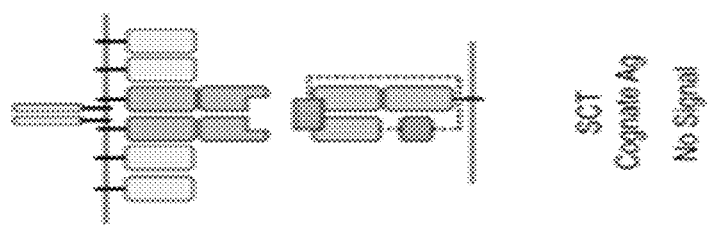
FIG. 7A

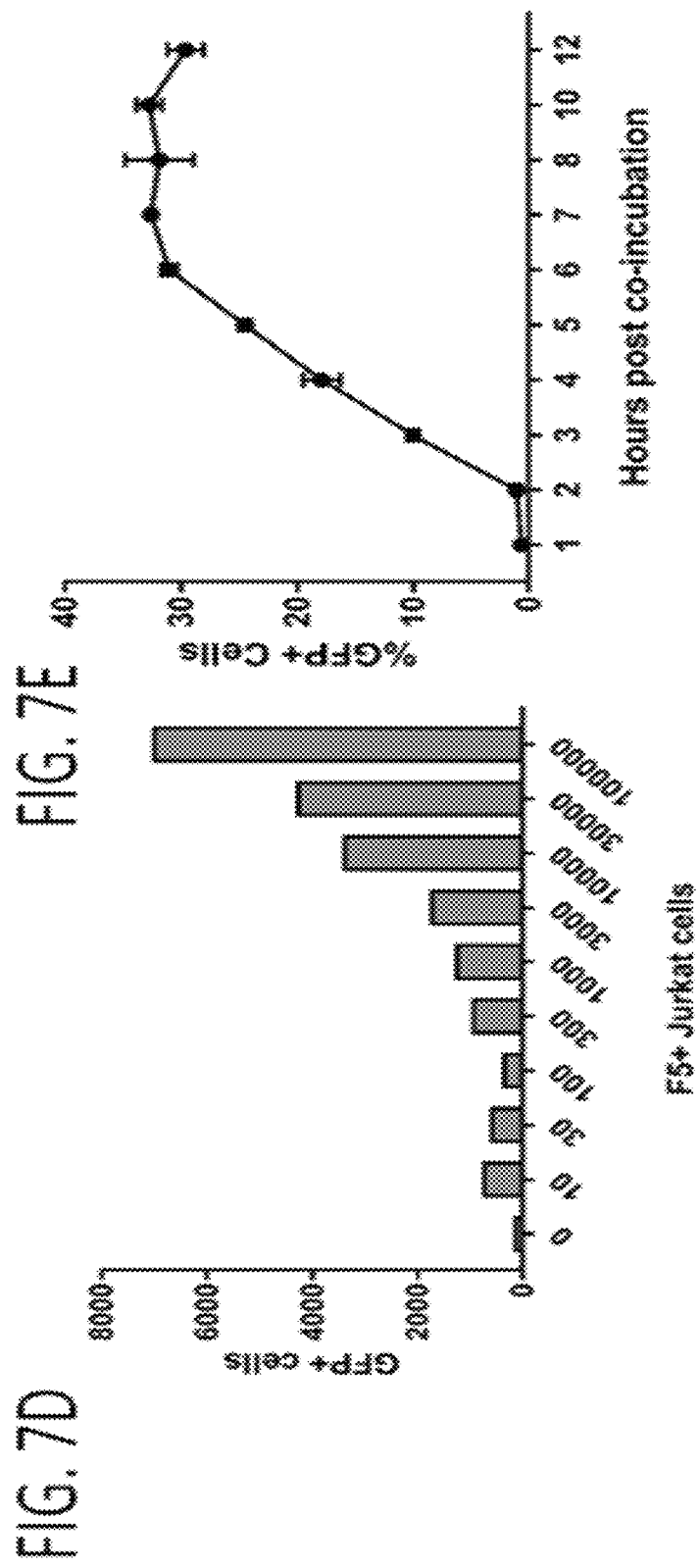

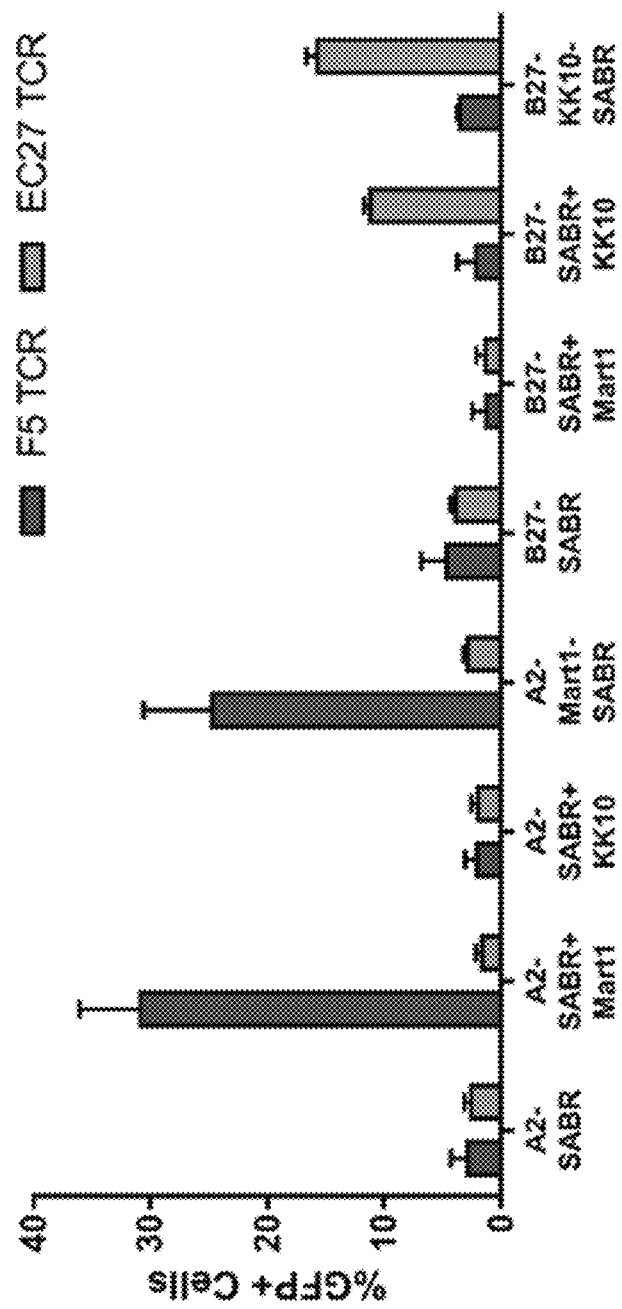
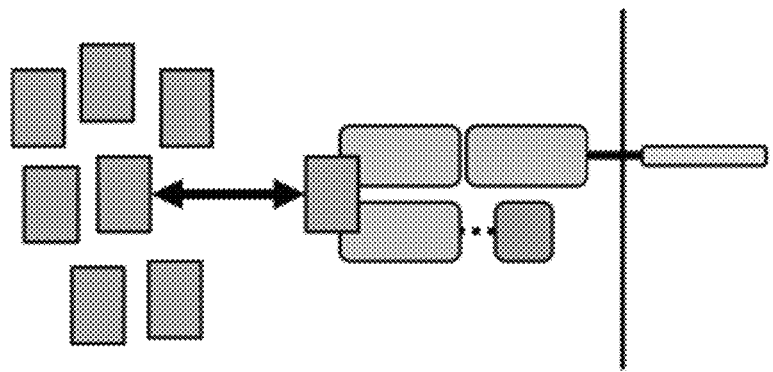
FIG. 8F
FIG. 8E

Cytoplasmic domains from DQA1*03:01 or DQB1*03:02

SABRs Induce Signal Transduction by 4 Hours

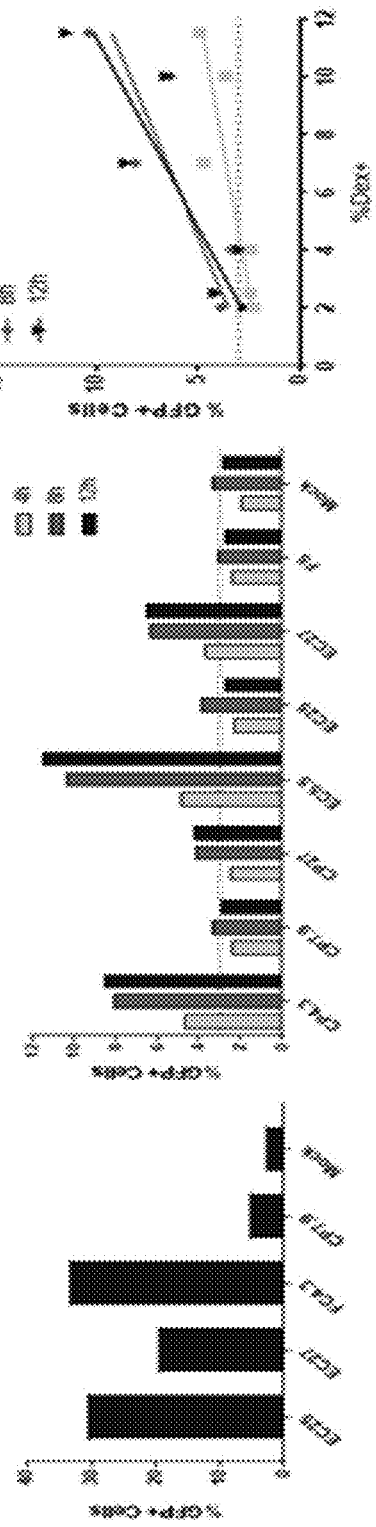
FIG. 18A
FIG. 18B
FIG. 18C

FIG. 19

HLA-A*0201-restricted CD8 T cell epitopes

| Antigen | Epitope | Sequence | Subjects* | |
|---|---|---|---|---|
| Preproinsulin | PPI$_{15-24}$ | ALWGPDPAAA | 14/14 | (SEQ ID NO. 806) |
| Insulin B chain | InsB$_{10-18}$ | HLVEALYLV | 10/13 | (SEQ ID NO. 787) |
| Islet-specific glucose-6-phosphatase catalytic subunit-related protein | IGRP$_{265-273}$ | VLFGLGFAI | 13/12 | (SEQ ID NO. 809) |
| Islet tyrosine phosphatase | IA-2$_{797-805}$ | MVWESGCTV | 11/13 | (SEQ ID NO. 1073) |
| Glutamic acid decarboxylase 65 | GAD65$_{114-123}$ | VMNILLQYVV | 11/10 | (SEQ ID NO. 805) |
| Cytomegalovirus pp65 | CMV pp65$_{495-503}$ | NLVPMVATV | 14/13 | (SEQ ID NO. 464) |
| Epstein-Barr virus BMLF1 | EBV BMLF1$_{280-288}$ | GLCTLVAML | 13/12 | (SEQ ID NO. 192) |

*Numbers of healthy controls/type 1 diabetes patients studied for each epitope specificity.

SIGNALING AND ANTIGEN-PRESENTING BIFUNCTIONAL RECEPTORS (SABR)

CROSS-REFERENCE TO RELATED APPLICATIONS

Any and all applications for which a foreign or domestic priority claim is identified in the Application Data Sheet as filed with the present application are hereby incorporated by reference under 37 CFR 1.57. This application claims the benefit of U.S. Provisional Application 62/554,652 filed on Sep. 6, 2017, which is hereby incorporated by reference in its entirety.

SEQUENCE LISTING STATEMENT

The present application is being filed along with a Sequence Listing in electronic format. The Sequence Listing is provided as a file entitled CALTE132ASEQUENCELIST Jan. 9, 2019, which is 1,950,041 bytes in size, updated by a file entitled CALTE132AREPLACEMENTSEQUENCE-LIST.txt, created on Mar. 18, 2019, which is 1,950,053 bytes in size; further updated by a file entitled CALTE132AREPLACEMENTSEQUENCELIST2.txt, created on Jun. 2, 2020, which is 1,950,207 bytes in size; and further updated by a file entitled CALTE132AREPLACEMENTSEQUENCE3.txt, created on Oct. 18, 2021, which is 1,950,172 bytes in size. The information in the electronic format of the Sequence Listing is incorporated herein by reference in its entirety.

BACKGROUND

Field

Embodiments described herein relate generally to molecules for immunological use and treatment.

Description

T cells are an integral part of the immune response to pathogens and cancers. T cells respond to specific antigenic epitopes presented on major histocompatibility complex (MHC) molecules on their target cells. Antigen recognition by T cells is mediated by their T cell receptor (TCR), which triggers an intracellular signal leading to T cell activation followed by a functional response. However, MHC molecules that present antigens lack signaling domains, and hence cannot induce a response in the target cells. Therefore, the TCR-Antigen-MHC interaction results in a unidirectional signal towards the T cell. Lack of signaling towards the target cells is a major limitation in the potential use of TCR-Antigen-MHC interactions for various functions. Thus, new, scalable techniques and molecules that expand the utilization of TCR-Antigen-MHC interactions are needed.

SUMMARY

Some embodiments herein relate to a signaling and antigen-presenting bifunctional receptor (SABR) comprising: an antigen presenting domain, and a signal transduction domain, wherein the antigen presenting domain comprises a binding fragment of a MHC molecule.

Some embodiments herein relate to a SABR, wherein the antigen presenting domain comprises a MHC.

Some embodiments herein relate to a nucleic acid encoding for a SABR.

Some embodiments herein relate to a cell comprising the nucleic acid encoding for a SABR.

Some embodiments herein relate to a SABR, wherein the MHC comprises a Class I MHC.

Some embodiments herein relate to a SABR, wherein the MHC comprises a Class II MHC.

Some embodiments herein relate to a SABR, further comprising a peptide, wherein the peptide comprises an epitope, wherein the peptide epitope is covalently linked to the SABR, and wherein the antigen presenting domain binds to the peptide.

Some embodiments herein relate to a SABR, wherein the signal transduction domain comprises a T cell signaling domain.

Some embodiments herein relate to a SABR, wherein the signal transduction domain is derived from a cytokine receptor, wherein the cytokine receptor comprises IL2, IL4, EPO, GM-CSF, JAK-STAT, CCL10, a G protein coupled receptor, or a receptor of the TNF Receptor superfamily.

Some embodiments herein relate to a SABR, wherein the signal transduction domain comprises 4-1BB (CD137), CD28, CD27, DAP10, ICOS, OX40, PD1, CTLA4, TIM3, CD3zeta, Notch, synNotch, chemical-induced dimerization, CD79A, CD79B, CD72, CD22, CD5, CD19, CD45, IL2, IL4, EPO, GM-CSF, JAK-STAT, CCL10, a G protein coupled receptor, a receptor of the TNF receptor superfamily, a NK cell receptor, a Fc receptor, a toll-like receptor, a RIG-I-like receptor, or a NOD-like receptors.

Some embodiments herein relate to a SABR, further comprising a transmembrane domain.

Some embodiments herein relate to a SABR, wherein the transmembrane domain comprises a transmembrane domain from one or more of 4-1BB (CD137), CD28, CD27, DAP10, ICOS, OX40, PD1, CTLA4, TIM3, CD3zeta, Notch, synNotch, chemical-induced dimerization, CD79A, CD79B, CD72, CD22, CD5, CD19, CD45, IL2, IL4, EPO, GM-CSF, JAK-STAT, CCL10, a G protein coupled receptor, a receptor of the TNF Receptor superfamily, a NK cell receptor, a Fc receptor, a toll-like receptor, a RIG-I-like receptor, a NOD-like receptor, or an MHC molecule.

Some embodiments herein relate to a SABR, wherein the transmembrane domain comprises any one or more of the transmembrane domains of Tables 0.1, 0.2, or 0.3 (as appropriate).

Some embodiments herein relate to a SABR, wherein the antigen presenting domain comprises any one or more of the antigen presenting domains of Tables 0.1, 0.2, or 0.3 (as appropriate).

Some embodiments herein relate to a SABR, wherein the signal transduction domain comprises any one or more of the signal transduction domains of Tables 0.1, 0.2, or 0.3 (as appropriate).

Some embodiments herein relate to a SABR, wherein the antigen presenting domain is fused to the signal transduction domain.

Some embodiments herein relate to a SABR, further comprising one or more linkers.

Some embodiments herein relate to a cell comprising: an extracellular peptide-MHC complex comprising: an antigen presenting domain linked to a signal transduction domain, wherein the antigen presenting domain comprises an MHC molecule.

Some embodiments herein relate to a cell, wherein the cell comprises any one or more of the SABRs described herein.

Some embodiments herein relate to an isolated nucleic acid molecule comprising a nucleotide sequence encoding any one of the SABRs described herein.

Some embodiments herein relate to a method for preparing a signaling cell, the method comprising: providing a target cell, and introducing into the target cell a nucleic acid molecule comprising a nucleotide sequence coding for a SABR directed against at least one TCR expressed at the surface of a T cell, wherein the SABR comprises a MHC linked to a signal transduction domain.

Some embodiments herein relate to a method for antigen discovery, the method comprising: expressing any of the SABRs described herein in at least one reporter cell, wherein the at least one reporter cell produces a measurable signal upon a signal transduction event that occurs upon binding of an antigen receptor to the antigen presenting domain, incubating the at least one reporter cell with the antigen receptor to be tested for binding to the SABR, detecting a presence of the measurable signal in the at least one reporter cell when the antigen receptor binds, and identifying the at least one reporter cell producing the measurable signal, thereby identifying an antigen by associating the SABR in the cell with the reporter, with the antigen receptor.

Some embodiments herein relate to a method for antigen discovery, wherein the antigen receptor comprises a soluble molecule.

Some embodiments herein relate to a method for antigen discovery, wherein the soluble molecule comprises an antibody.

Some embodiments herein relate to a method for antigen discovery, wherein the antigen receptor is expressed on a cell.

Some embodiments herein relate to a method for antigen discovery, wherein the antigen receptor comprises a TCR expressed on a T cell.

Some embodiments herein relate to a method for antigen discovery, wherein the at least one reporter cell comprises a library of cells, wherein the library of cells have numerous different SABRs, and wherein the numerous different SABRs can bind to different antigen receptors.

Some embodiments herein relate to a method for antigen discovery, wherein the antigen receptor comprises numerous antigen receptors.

Some embodiments herein relate to a method for antigen discovery, wherein numerous different SABRs are expressed and one determines which SABR a particular antigen receptor binds to by monitoring the measurable signal and identifying which SABR is in the cell that exhibited the measurable signal.

Some embodiments herein relate to a method for antigen discovery, wherein more than one antigen receptor is present and one determines which antigen receptor binds to a particular SABR.

Some embodiments herein relate to a method for antigen discovery, wherein more than one antigen receptor and more than one SABR are present.

Some embodiments herein relate to a method for antigen discovery, wherein the at least one reporter cell comprises NFAT-GFP-Jurkat cells.

Some embodiments herein relate to a method for antigen discovery, wherein the measurable signal comes from expression of a detectable marker.

Some embodiments herein relate to a method for antigen discovery, wherein the reporter cells expressing the measurable signal are identified using flow cytometry.

Some embodiments herein relate to a method for antigen discovery, wherein the antigen receptor comprises an expressed orphan TCR.

Some embodiments herein relate to a method for antigen discovery, wherein the one or more reporter cells expresses a genetically encoded antigen or antigenic epitope.

Some embodiments herein relate to a method for antigen discovery, further comprising identifying the genetically encoded antigen or antigenic epitope by DNA sequencing.

Some embodiments herein relate to a library comprising: any of the SABRs described herein, and at least one candidate antigen receptor.

Some embodiments herein relate to a library, wherein the at least one antigen receptor is expressed on a cell, wherein the cell is an antigen receptor cell.

Some embodiments herein relate to a library, wherein the SABR is expressed on a reporter cell, such that the cell provides a detectable marker upon binding of the SABR to the antigen receptor.

Some embodiments herein relate to a library, wherein the reporter cell comprises NFAT-GFP-Jurkat cells.

Some embodiments herein relate to a library, wherein the antigen receptor cell comprises T cells comprising TCR.

Some embodiments herein relate to a library, wherein the antigen receptor cell comprises a cell expressing orphan TCR.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject.

Some embodiments herein relate to a method for initiating a therapeutic response, wherein the cellular response results in one or more of: cell mediated cytotoxicity, release of inflammatory cytokines, release of suppressive cytokines, direct suppression of target cells, release of anti-inflammatory cytokines, induction of pro-proliferative signals, induction of anti-proliferative signals, induction of apoptosis, induction of cell exhaustion markers, and direct target cell activation.

Some embodiments herein relate to a method for initiating a therapeutic response, wherein the therapeutic cell destroys a pathogenic T cell.

Some embodiments herein relate to a method for initiating a therapeutic response wherein the therapeutic cell activates a target T cell.

Some embodiments herein relate to a method for initiating a therapeutic response, wherein the therapeutic cell suppresses a pathogenic T cell.

Some embodiments herein relate to a composition comprising: a therapeutic T-cell comprising any of the SABRs described herein.

Some embodiments herein relate to a method for treating a patient comprising introducing into the patient a therapeutic T cell comprising an extracellular peptide-MHC complex, the peptide-MHC complex comprising an antigen presenting domain linked to a signal transduction domain, wherein the antigen presenting domain comprises an MHC.

Some embodiments herein relate to a SABR comprising: an extracellular binding domain comprising an MHC and a peptide epitope, a transmembrane domain, and a cytoplasmic signaling domain.

BRIEF DESCRIPTION OF THE DRAWINGS

FIG. 1D illustrates a typical antigen presenting cell with an antigen presenting domain but no transduction signaling domain.

FIG. 1E illustrates an antigen presenting cell with a SABR comprising both an antigen presenting domain and a transduction signaling domain capable of signal induction within an antigen presenting cell.

FIG. 2A illustrates a schematic describing a use of SABRs in a reporter cell line that expresses a signal upon TCR binding or recognition according to various embodiments herein.

FIG. 7A illustrates schematics demonstrating SABRs and TCR-pMHC specific signaling.

FIG. 7D illustrates a graph of detection of low cell numbers by SABRs.

FIG. 7E illustrates a timecourse of GFP expression by A2-MART1-SABR transduced NFAT-GFP-Jurkat cells co-cultured with F5-transduced Jurkat cells.

FIG. 8E illustrates a schematic of empty SABRs pulsed with exogenous peptide.

FIG. 8F illustrates a graph showing GFP expression by NFAT-GFP-Jurkats transduced with empty SABRs pulsed with soluble MART1 or KK10 peptides and co-cultured with Jurkat cells transduced with F5 or EC27 TCRs.

FIG. 18A illustrates a bar graph depicting the frequency of % GFP+ for TCR-transduced Jurkat cells incubated with SCTR-transduced NFAT-GFP-Jurkat cells.

FIG. 18B illustrates a bar graph depicting the frequency of % GFP+ for TCR-transduced PBMCs incubated with SCTR-transduced NFAT-GFP-Jurkat cells.

FIG. 18C illustrates a line graph depicting the frequency over time of % GFP+ for TCR-transduced PBMCs incubated with SCTR-transduced NFAT-GFP-Jurkat cells.

FIG. 19 illustrates examples of antigenic epitopes according to various embodiments herein (e.g., for the treatment of diabetes).

DETAILED DESCRIPTION

Figure 1A:
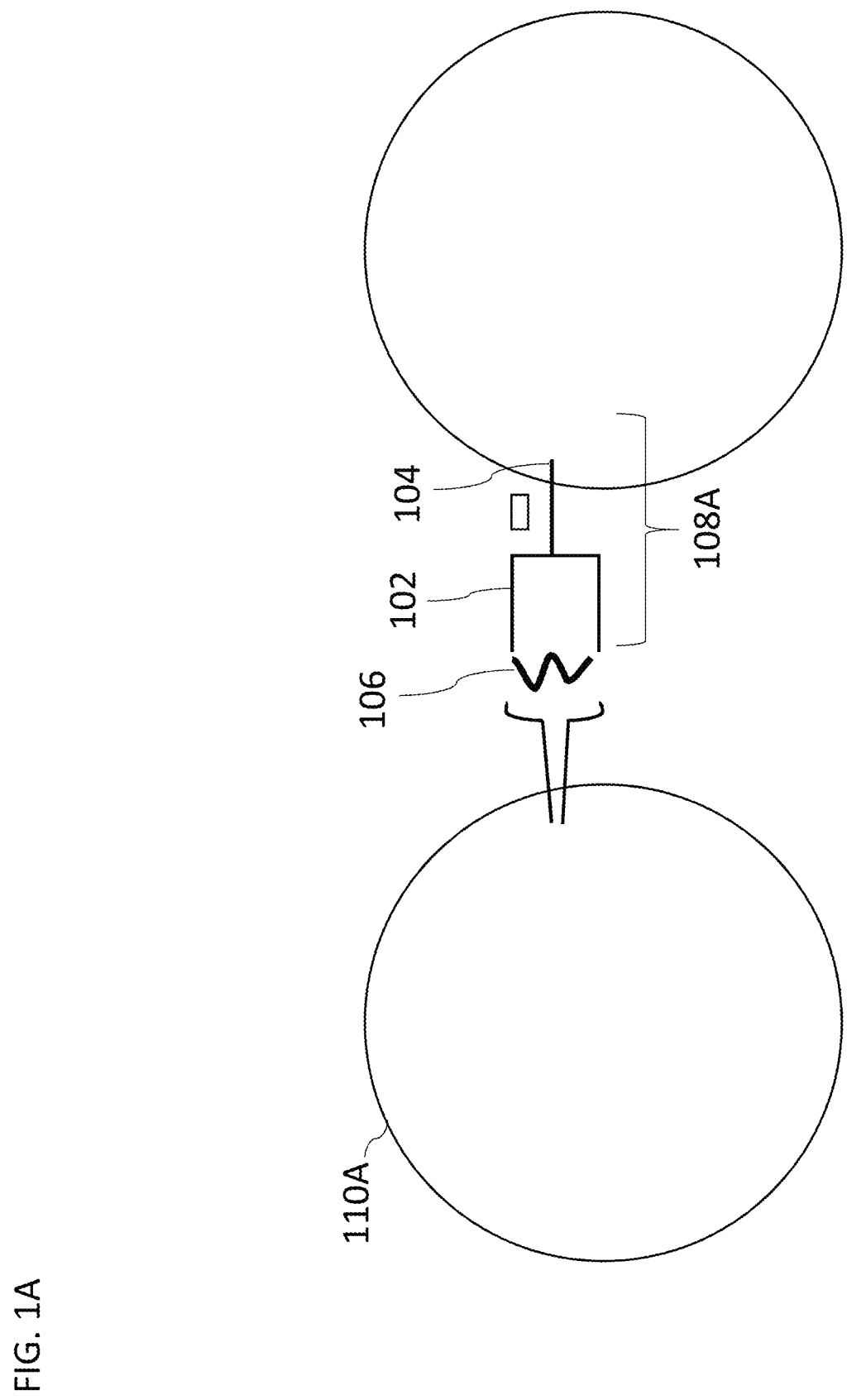
FIG. 1A illustrates an example SABR construct with CD8+ T cells according to various embodiments herein.

MHC molecules that present antigens lack signaling domains, and hence cannot induce a response in the target cells. Therefore, a TCR-Antigen-MHC interaction results in a unidirectional signal towards the T cell. Lack of signaling towards the target cells is a major limitation in the potential use of TCR-Antigen-MHC interactions for various functions. Thus, new, scalable techniques and molecules that expand the utilization of TCR-Antigen-MHC interactions are needed and are provided herein (in some embodiments).

Described herein are compositions and methods for signaling and antigen-presenting bifunctional receptors (SA-BRs) comprising: one or more antigen presenting domains, and one or more signal transduction domains, wherein the one or more antigen presenting domains comprise a binding fragment of a major histocompatibility complex (MHC) molecule. Various immunological functions of the SABRs are also described. Various uses and functions of the SABRs are provided herein. For example, in some embodiments, the SABRs described herein may be used for antigen discovery, for suppressing and/or destroying pathogenic T cells, for initiating therapeutic responses, in methods of treatment, for construction of SABR libraries, for neoantigen discovery, as well as other uses.

Definitions and Various Embodiments

As used herein, the section headings are for organizational purposes only and are not to be construed as limiting the described subject matter in any way. All literature and similar materials cited in this application, including but not limited to, patents, patent applications, articles, books, treatises, and internet web pages are expressly incorporated by reference in their entirety for any purpose. When definitions of terms in incorporated references appear to differ from the definitions provided in the present teachings, the definition provided in the present teachings shall control.

In this application, the use of the singular includes the plural unless specifically stated otherwise. Also, the use of "comprise", "comprises", "comprising", "contain", "contains", "containing", "include", "includes", and "including" are not intended to be limiting. It is to be understood that both the foregoing general description and the following detailed description are exemplary and explanatory only and are not restrictive. Unless defined otherwise, technical and scientific terms used herein have the same meaning as commonly understood by one of ordinary skill in the art to which this invention belongs. See, for example Singleton et al., Dictionary of Microbiology and Molecular Biology 2$^{nd}$ ed., J. Wiley & Sons (New York, N.Y. 1994); Sambrook et al., Molecular Cloning, A Laboratory Manual, Cold Springs Harbor Press (Cold Springs Harbor, N.Y. 1989). For purposes of the present invention, the following terms are defined below. It is to be understood that both the foregoing general description and the following detailed description. are exemplary and explanatory only and are not restrictive of the invention as claimed. In this application, the use of the singular includes the plural unless specifically stated otherwise. In this application, the use of "or" means "and/or" unless stated otherwise. Furthermore, the use of the term "including", as well as other forms, such as "includes" and "included", is not limiting. As used in this specification and claims, the singular forms "a," "an" and "the" include plural references unless the content clearly dictates otherwise.

As used herein, "about" means a quantity, level, value, number, frequency, percentage, dimension, size, amount, weight or length that varies by as much as 30, 25, 20, 15, 10, 9, 8, 7, 6, 5, 4, 3, 2 or 1% to a reference quantity, level, value, number, frequency, percentage, dimension, size, amount, weight or length.

As used herein, an "antigen presenting domain" refers to an extracellular domain that functions to present antigen peptide fragments to T cells responsible for cell-mediated immune responses.

As used herein, a "signal transduction domain" refers to any domain that can transmit an extracellular signal intracellularly.

As used herein, a "major histocompatibility molecule" (MHC) refers to a set of cell surface proteins essential for the acquired immune system to recognize foreign molecules. Unless otherwise noted, MHC refers to both Class I MHC and Class II MHC.

As used herein, "peptide" refers to a chain of amino acids linked to each other by peptide bonds.

As used herein, "epitope" refers to a part of an antigen that is recognized by the immune system. This can be by, for example, antibodies, B cells, or T cells.

As used herein, "T cell signaling domain" refers to a cytoplasmic T cell domain that functions to transmit an intracellular signal.

As used herein, "cytokine receptor" refers to any receptor that bind cytokines.

As used herein, "transmembrane domain" refers to an amino acid sequence that traverses and is present in the cell membrane.

As used herein, a "linker" refers to a peptide sequence occurring between protein domains.

As used herein, a "signaling cell" refers to any cell any cell that is capable for transmitting an extracellular signal intracellularly through a signaling domain.

As used herein, a "target cell" refers to a cell that bears receptors recognized by a signaling molecule.

As used herein, a "reporter cell" refers to a cell expressing reporter genes, which, when exposed to a stimulus, induces a measurable signal activity that can be readily assessed qualitatively and quantitatively.

As used herein, a "measurable signal" refers to any reporter activity that can be assessed qualitatively or quantitatively.

As used herein, "antigen discovery" refers to the process of discovering the antigens targeted by T cell responses.

As used herein, a "soluble molecule" refers to a compound soluble in a liquid.

As used herein, a "library" refers to a collection of cells having one or more signaling molecules.

As used herein, a "detectable marker" refers to any discernable characteristic in response to signal transduction.

As used herein, "flow cytometry" refers to a laser- or impedance-based, biophysical technology employed in cell counting, cell sorting, biomarker detection and protein engineering, by suspending cells in a stream of fluid and passing them through an electronic detection apparatus.

As used herein, a "therapeutic cell" refers to a cell transduced with a SABR, wherein the SABR directs a cellular response in a subject upon binding to an antigen receptor in the subject.

As used herein, a "cellular response" refers to any biochemical reaction within a cell in response to a received signal.

As used herein, a "pathogenic T cell" refers to any T cell that causes or contributes to a disease, for example, in an autoimmune disease.

As used herein, a "cytoplasmic domain" refers to amino acid sequences within the cytoplasm of a cell.

As used herein, a "vector," interchangeably referred to as a transgenic construct, a targeting construct, or simply a construct, is a nucleic acid. As used herein, "nucleic acid" refers to deoxyribonucleic acid (DNA). In some embodiments, nucleic acid may refer to ribonucleic acid (RNA). In some embodiments, the construct as provided herein comprise one or more regulatory elements. Exemplary regulatory elements in prokaryotes include promoters, operators and ribosome binding sites. Regulatory elements that are used in eukaryotic cells can include, without limitation, transcriptional and translational control sequences, such as promoters, terminators, enhancers, insulators, splicing signals, polyadenylation signals, terminators, protein degradation signals, internal ribosome-entry element (IRES), 2A sequences, and the like, that provide for and/or regulate expression of a coding sequence and/or production of an encoded polypeptide in a host cell. For example, a promoter is a nucleotide sequence that permits binding of RNA polymerase and directs the transcription of a gene. Typically, a promoter is located in the 5' non-coding region of a gene, proximal to the transcriptional start site of the gene. Sequence elements within promoters that function in the initiation of transcription are often characterized by consensus nucleotide sequences. Examples of promoters include, but are not limited to, promoters from bacteria, yeast, plants, viruses, and mammals (including humans). A promoter can be inducible, repressible, and/or constitutive. Inducible promoters initiate increased levels of transcription from DNA under their control in response to some change in culture conditions (for example, a change in temperature). "Treating" or "treatment" of a condition may refer to preventing the condition, slowing the onset and/or rate of development of the condition, reducing the risk of developing the condition, preventing and/or delaying the development of symptoms associated with the condition, reducing or ending symptoms associated with the condition, generating a complete or partial regression of the condition, or some combination thereof. The term "prevent" does not require the absolute prohibition of the disorder or disease.

A "therapeutically effective amount" or a "therapeutically effective dose" is an amount that produces a desired therapeutic effect in a subject, such as preventing, treating a target condition, delaying the onset of the disorder and/or symptoms, and/or alleviating symptoms associated with the condition. This amount will vary depending upon a variety of factors, including but not limited to the characteristics of the therapeutic compound (including activity, pharmacokinetics, pharmacodynamics, and bioavailability), the physiological condition of the subject (including age, sex, disease type and stage, general physical condition, responsiveness to a given dosage, and type of medication), the nature of the pharmaceutically acceptable carrier or carriers in the formulation, and/or the route of administration. One skilled in the clinical and pharmacological arts will be able to determine a therapeutically effective amount through routine experimentation, for example by monitoring a subject's response to administration of a compound and adjusting the dosage accordingly, given the present disclosure. For additional guidance, see Remington: The Science and Practice of Pharmacy 21.sup.st Edition, Univ. of Sciences in Philadelphia (USIP), Lippincott Williams & Wilkins, Philadelphia, Pa., 2005.

The term "antibody" includes, but is not limited to, genetically engineered or otherwise modified forms of immunoglobulins, such as intrabodies, chimeric antibodies, fully human antibodies, humanized antibodies, antibody fragments, and heteroconjugate antibodies (e.g., bispecific antibodies, diabodies, triabodies, tetrabodies, etc.). The term "antibody" includes cys-diabodies and minibodies. The term "antibody" includes a polypeptide of the immunoglobulin family or a polypeptide comprising fragments of an immunoglobulin that is capable of noncovalently, reversibly, and in a specific manner binding a corresponding antigen. An exemplary antibody structural unit comprises a tetramer. In some embodiments, a full-length antibody can be composed of two identical pairs of polypeptide chains, each pair having one "light" and one "heavy" chain (connected through a disulfide bond. The recognized immunoglobulin genes include the kappa, lambda, alpha, gamma, delta, epsilon, and mu constant region genes, as well as the myriad immunoglobulin variable region genes. For full length chains, the light chains are classified as either kappa or lambda. For full length chains, the heavy chains are classified as gamma, mu, alpha, delta, or epsilon, which in turn define the immunoglobulin classes, IgG, IgM, IgA, IgD, and IgE, respectively. The N-terminus of each chain defines a variable region of about 100 to 110 or more amino acids primarily responsible for antigen recognition. The terms variable light chain (VL) and variable heavy chain (VH) refer to these regions of light and heavy chains respectively. As used in this application, an "antibody" encompasses all variations of antibody and fragments thereof. Thus, within the scope of this concept are full length antibodies, chimeric antibodies, humanized antibodies, single chain antibodies (scFv), Fab, Fab', and multimeric versions of these fragments (e.g., F(ab')2) with the same binding specificity. In some embodiments, the antibody binds specifically to a desired target.

The term "isolated," when applied to a nucleic acid or protein, denotes that the nucleic acid or protein is essentially free of other cellular components with which it is associated in the natural state. In some embodiments, it can be in either a dry or aqueous solution. Purity and homogeneity can be determined using analytical chemistry techniques such as polyacrylamide gel electrophoresis or high performance liquid chromatography. A protein that is the predominant species present in a preparation is substantially purified. In particular, an isolated gene is separated from open reading frames that flank the gene and encode a protein other than the gene of interest. The term "purified" denotes that a nucleic acid or protein gives rise to essentially one band in an electrophoretic gel. In some embodiments, this can denote that the nucleic acid or protein is at least 85% pure, more preferably at least 95% pure, and most preferably at least 99% pure of molecules that are present under in vivo conditions.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, gamma-carboxyglutamate, and O-phosphoserine. Amino acid analogs refer to compounds that have the same basic chemical structure as a naturally occurring amino acid, i.e., an alpha.-carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

Signaling and Antigen-Presenting Bifunctional Receptors

Some embodiments provided herein relate to a signaling and antigen-presenting bifunctional receptor (SABR) comprising: an antigen presenting domain, and a signal transduction domain. The antigen presenting domain comprises a binding fragment of a major histocompatibility complex (MHC) molecule. In some embodiments, the SABRs herein allow transduction of a signal within a target cell, which has various application as describe herein. Some embodiments provided herein relate to a SABR comprising: one or more antigen presenting domains, and a signal transduction domain, wherein the one or more antigen presenting domains comprise a binding fragment of a MHC molecule. Some embodiments provided herein relate to a SABR comprising: an antigen presenting domain, and one or more signal transduction domains, wherein the antigen presenting domain comprises a binding fragment of a MHC molecule. Some embodiments provided herein relate to a SABR comprising: one or more antigen presenting domains, and one or more signal transduction domains, wherein the one or more antigen presenting domains comprises a binding fragment of a MHC molecule.

Figure 1B:
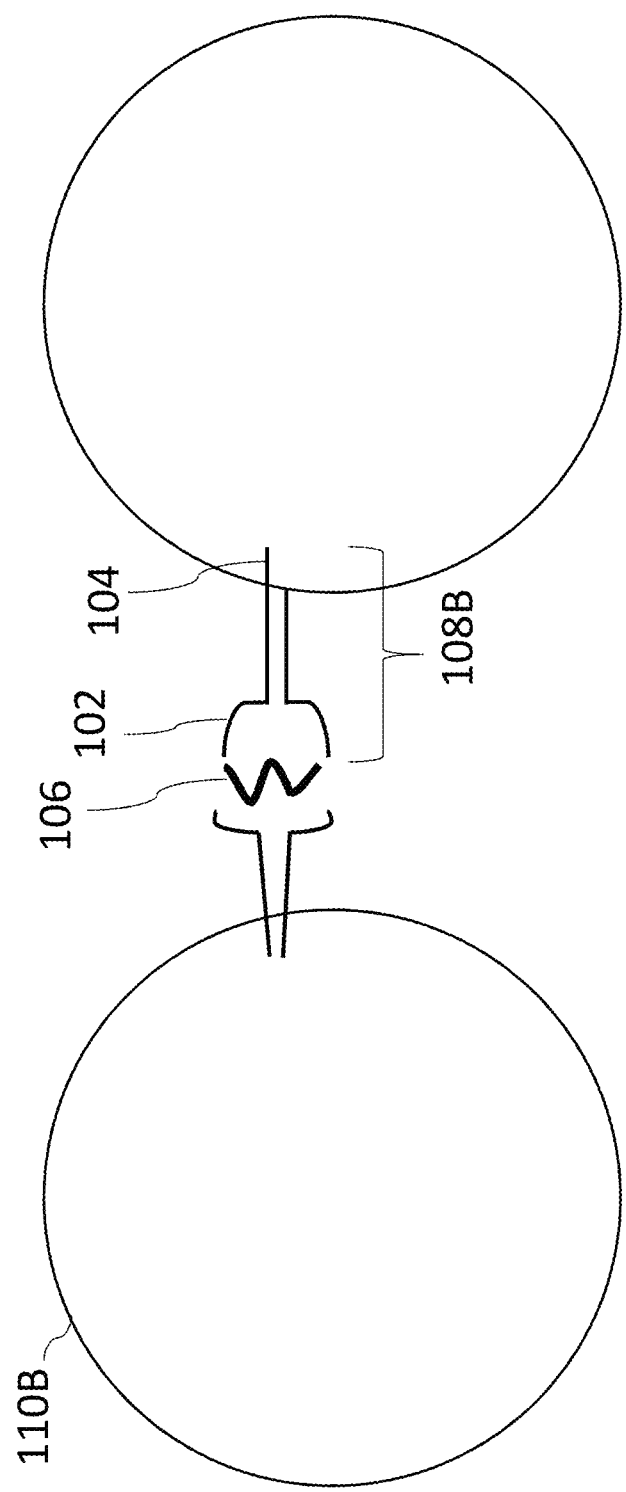
FIG. 1B illustrates an example SABR construct with CD4+ T cells according to various embodiments herein.

FIG. 1A illustrates an example SABR construct with CD8+ T cells according to various embodiments herein. FIG. 1B illustrates an example SABR construct with CD4+ T cells according to various embodiments herein. In some embodiments, SABRs are constructed by linking two parts: antigen-presenting domains 102 and signal transduction domains 104. Antigen presentation to a T cell is dependent on class I and class II MHC molecules, which present peptide epitopes 106 to T cells. Class I MHC molecules 108A usually present 8-11aa long peptide epitopes to CD8+ T cells 110A, whereas Class II MHC 108B usually molecules present 12-15aa long peptide epitopes to CD4+ T cells 110B. In some embodiments, SABRs are created by linking antigen presenting domains 102 to signal transduction domains 104.

Figure 1C:
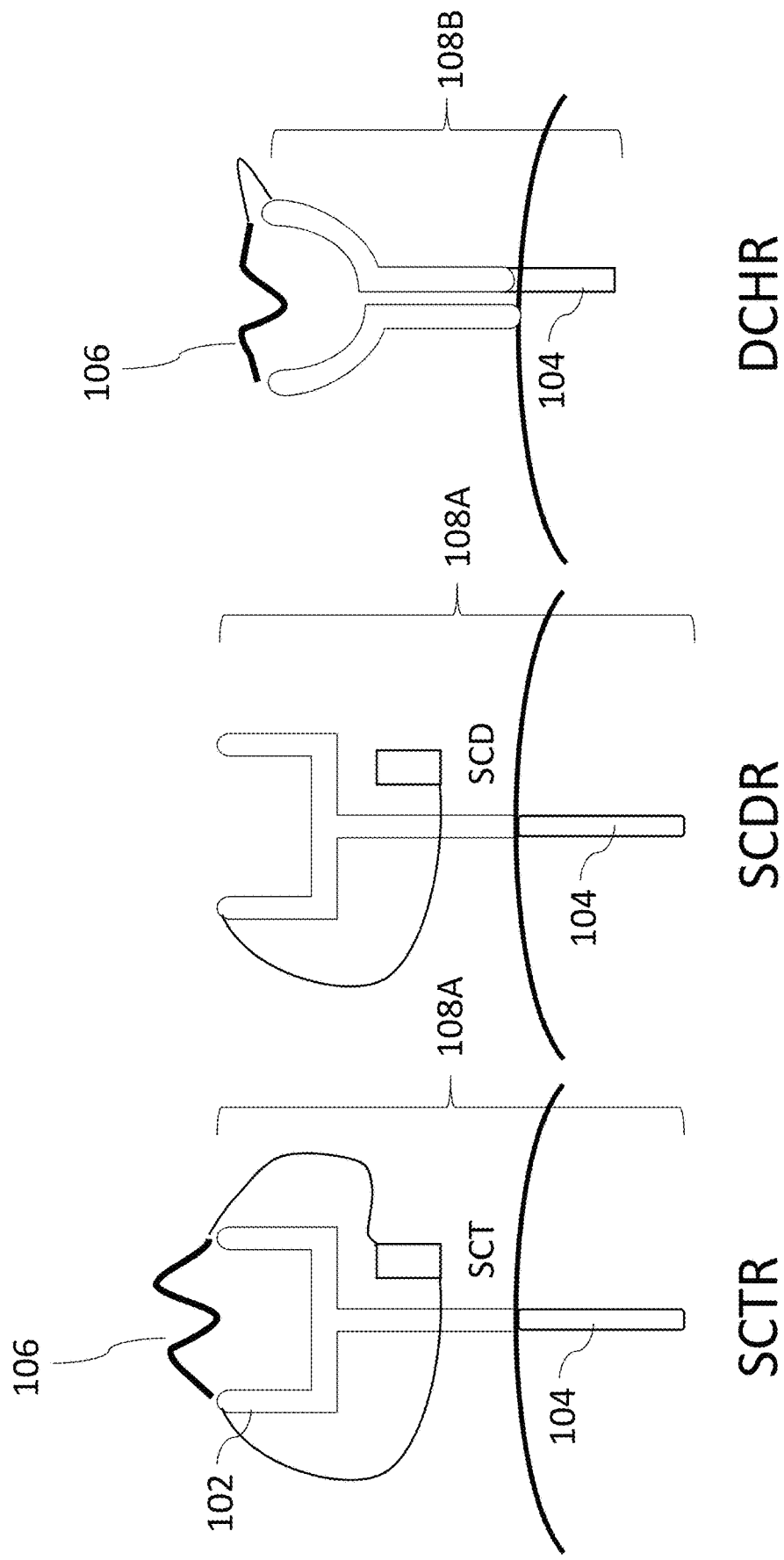
FIG. 1C illustrates SABR constructs according to various embodiments herein.

FIG. 1C illustrates SABR constructs according to various embodiments herein. In some embodiments, the antigen presenting domains 102 can be a class I MHC molecule 108A with covalently linked peptide 106 (SCTRs), or class I MHC molecule 108A without any peptide epitope (SCDRs), or a class II MHC molecules 108B with covalently linked peptide 106 (DCHR). In some embodiments, the signaling domains 104 can be derived from TCR-CD3 signaling domains similar to those used in chimeric antigen receptors (CARs), from cytokine receptors, or from other receptors that signal upon multimerization. In some embodiments, SABR-libraries can be constructed either by covalently linking the antigenic epitope or expressing the antigenic protein/epitope in SABR-expressing cells.

FIG. 1D illustrates a typical antigen presenting cell 100D with an antigen presenting domain 102D but no transduction signaling domain. FIG. 1E illustrates an antigen presenting cell 100E with a SABR comprising both an antigen presenting domain 102E and a transduction signaling domain 104E capable of signal induction within the antigen presenting cell 100E.

Some embodiments provided herein relate to a SABR comprising: an antigen presenting domain, and a signal transduction domain, wherein the antigen presenting domain comprises a binding fragment of a MHC molecule, and wherein the antigen presenting domain comprises a MHC.

Some embodiments provided herein relate to a nucleic acid encoding for any of the SABRs described herein. Some embodiments provided herein relate to a nucleic acid encoding for a SABR comprising: an antigen presenting domain, and a signal transduction domain, wherein the antigen presenting domain comprises a binding fragment of a MHC molecule.

Some embodiments provided herein relate to a cell comprising a nucleic acid encoding for any of the SABRs described herein. Some embodiments provided herein relate to a nucleic acid encoding for a SABR comprising: an antigen presenting domain, and a signal transduction domain, wherein the antigen presenting domain comprises a binding fragment of a MHC molecule.

Some embodiments provided herein relate to a SABR comprising: an antigen presenting domain, and a signal transduction domain, wherein the antigen presenting domain comprises a binding fragment of a MHC molecule, and wherein the MHC comprises a Class I MHC.

Some embodiments provided herein relate to a SABR comprising: an antigen presenting domain, and a signal transduction domain, wherein the antigen presenting domain comprises a binding fragment of a MHC molecule, and wherein the MHC comprises a Class II MHC.

Some embodiments provided herein relate to any of the SABRs described herein, further comprising a peptide. Some embodiments provided herein relate to a SABR comprising: an antigen presenting domain, a signal transduction domain, wherein the antigen presenting domain comprises a binding fragment of a MHC molecule, and a peptide. Some embodiments provided herein relate to a SABR wherein the peptide comprises an epitope. In some embodiments, any of the epitopes in tables 6.3 or 6.4 can be employed. Some embodiments provided herein relate to a SABR comprising: an antigen presenting domain, a signal transduction domain, wherein the antigen presenting domain comprises a binding fragment of a MHC molecule, and a peptide, wherein the peptide comprises an epitope, and wherein the peptide epitope is covalently linked to the SABR. Some embodiments provided herein relate to a SABR comprising: an antigen presenting domain, a signal transduction domain, wherein the antigen presenting domain comprises a binding fragment of a MHC molecule, and a peptide, wherein the peptide comprises an epitope, wherein the peptide epitope is covalently linked to the SABR, and wherein the antigen presenting domain binds to the peptide. Some embodiments provided herein relate to a SABR comprising: an antigen presenting domain, a signal transduction domain, wherein the antigen presenting domain comprises a binding fragment of a MHC molecule, and a peptide, wherein the peptide comprises an epitope, wherein the peptide epitope is covalently linked to the SABR, and wherein the antigen presenting domain does not bind to the peptide.

Some embodiments provided herein relate to a SABR comprising: an antigen presenting domain, and a signal transduction domain, wherein the antigen presenting domain comprises a binding fragment of a MHC molecule, and wherein the signal transduction domain comprises a T cell signaling domain. Some embodiments provided herein relate to a SABR comprising: an antigen presenting domain, and a signal transduction domain, wherein the antigen presenting domain comprises a binding fragment of a MHC molecule. Some embodiments provided herein relate to a SABR wherein the signal transduction domain comprises a T cell signaling domain. Some embodiments provided herein relate to a SABR wherein the T cell signaling domain comprises 4-1BB (CD137), CD28, CD27, DAP10, ICOS, OX40, PD1, CTLA4, TIM3, or CD3zeta. Some embodiments provided herein relate to a SABR comprising: an antigen presenting domain, and a signal transduction domain, wherein the antigen presenting domain comprises a binding fragment of a MHC molecule, wherein the signal transduction domain comprises a T cell signaling domain, and wherein the T cell signaling domain comprises PMID: 23667569, PMID: 22437870, PMID: 23667569, PMID: 22437870, PMID: 23667569, PMID: 22437870, PMID: 23667569, PMID: 22437870, PMID: 23667569, PMID: 22437870, PMID: 23667569, or PMID: 22437870. Some embodiments provided herein relate to a SABR comprising: an antigen presenting domain, and a signal transduction domain, wherein the antigen presenting domain comprises a binding fragment of a MHC molecule, wherein the signal transduction domain comprises a T cell signaling domain. Some embodiments provided herein relate to a SABR wherein the T cell signaling domain comprises one or more of the domains of Table 0.1. In some embodiments, fragments of one or more of the following items in Table 0.1 can also be employed.

TABLE 0.1

| Domain | Class/Source | Function | Ref |
|---|---|---|---|
| 4-1BB (CD137) | T cell signaling | Antigen discovery, Fratricide Immunotherapy, Tolerogenic Immunotherapy | PMID: 23667569, PMID: 22437870 |
| CD28 | T cell signaling | Antigen discovery, Fratricide Immunotherapy, Tolerogenic Immunotherapy | PMID: 23667569, PMID: 22437870 |
| CD27 | T cell signaling | Antigen discovery, Fratricide Immunotherapy, Tolerogenic Immunotherapy | PMID: 23667569, PMID: 22437870 |
| DAP10 | T cell signaling | Antigen discovery, Fratricide Immunotherapy, Tolerogenic Immunotherapy | PMID: 23667569, PMID: 22437870 |
| ICOS, OX40, PD1, CTLA4, TIM3 | T cell signaling | Antigen discovery, Fratricide Immunotherapy, Tolerogenic Immunotherapy, Modulating exhaustion | PMID: 23667569, PMID: 22437870 |
| CD3zeta | T cell signaling | Antigen discovery, Fratricide Immunotherapy, Tolerogenic Immunotherapy | PMID: 23667569, PMID: 22437870 |

Some embodiments provided herein relate to a SABR comprising: an antigen presenting domain, and a signal transduction domain, wherein the antigen presenting domain comprises a binding fragment of a MHC molecule. Some embodiments provided herein relate to a SABR wherein the signal transduction domain is derived from a cytokine receptor. Some embodiments provided herein relate to a SABR comprising: an antigen presenting domain, and a signal transduction domain, wherein the antigen presenting domain comprises a binding fragment of a MHC molecule, wherein the signal transduction domain is derived from a cytokine receptor. Some embodiments provided herein relate to a SABR wherein the cytokine receptor comprises IL2, IL4, EPO, GM-CSF, JAK-STAT, CCL10, a G protein coupled receptor, or a receptor of the TNF Receptor superfamily. Some embodiments provided herein relate to a SABR wherein the signal transduction domain is derived from a cytokine receptor, wherein the cytokine receptor comprises PMID: 17934481, PMID: 10808165, PMID: 27317733, PMID: 17934481, PMID: 10808165, PMID: 27317733, PMID: 24679437, PMID: 24679437, PMID: 19239902. Some embodiments provided herein relate to a SABR wherein the cytokine receptor comprises one or more of the domains of Table 0.2. In some embodiments, a fragment of the cytokine receptor can be employed.

TABLE 0.2

| Domain | Class/Source | Function | Ref |
|---|---|---|---|
| Cytokines such as IL2, IL4, EPO, GM-CSF | Cytokine signaling | Tolerogenic Immunotherapy, Immunomodulation, Vaccine boost | PMID: 17934481; PMID: 10808165; PMID: 27317733 |
| JAK-STAT | Cytokine signaling | Tolerogenic Immunotherapy, Immunomodulation, Vaccine boost | PMID: 17934481; PMID: 10808165; PMID: 27317733 |
| Chemokines such as CCL10 | Cytokine signaling | Tolerogenic Immunotherapy, Immunomodulation, Vaccine boost | PMID: 24679437 |
| G protein coupled receptors | Cytokine signaling | Tolerogenic Immunotherapy, Immunomodulation, Vaccine boost | PMID: 24679437 |
| TNF Receptor superfamily | Cytokine signaling | Immunomodulation, Vaccine boost | PMID: 19239902 |

Some embodiments provided herein relate to a SABR wherein the signal transduction domain comprises 4-1BB (CD137), CD28, CD27, DAP10, ICOS, OX40, PD1, CTLA4, TIM3, CD3zeta, Notch, synNotch, chemical-induced dimerization, CD79A, CD79B, CD72, CD22, CD5, CD19, CD45, IL2, IL4, EPO, GM-CSF, JAK-STAT, CCL10, a G protein coupled receptor, a receptor of the TNF Receptor superfamily, a NK cell receptor, a Fc receptor, a toll-like receptor, a RIG-I-like receptor, or a NOD-like receptor. Some embodiments provided herein relate to a SABR comprising: an antigen presenting domain, and a signal transduction domain, wherein the antigen presenting domain comprises a binding fragment of a MHC molecule, and wherein the signal transduction domain comprises PMID: 23667569, PMID: 22437870, PMID: 23667569, PMID: 22437870, PMID: 23667569, PMID: 22437870, PMID: 23667569, PMID: 22437870, PMID: 23667569, PMID: 22437870, PMID: 26830878, U.S. Pat. No. 9,670,281, PMID: 26431673, PMID: 21816833, PMID: 17934481, PMID: 10808165, PMID: 27317733, PMID: 17934481, PMID: 10808165, PMID: 27317733, PMID: 24679437, PMID: 19239902, PMID: 20567250, PMID: 25045879, PMID: 15932016, PMID: 21616437, or PMID: 26632377. Some embodiments provided herein relate to a SABR and wherein the signal transduction domain comprises one or more of the domains of Table 0.3. In some embodiments, a fragment of the signal transduction domain in Table 0.3 can be employed.

TABLE 0.3

| Domain | Class/Source | Function | Ref |
|---|---|---|---|
| 4-1BB (CD137) | T cell signaling | Antigen discovery, Fratricide Immunotherapy, Tolerogenic Immunotherapy | PMID: 23667569, PMID: 22437870 |
| CD28 | T cell signaling | Antigen discovery, Fratricide Immunotherapy, Tolerogenic Immunotherapy | PMID: 23667569, PMID: 22437870 |
| CD27 | T cell signaling | Antigen discovery, Fratricide Immunotherapy, Tolerogenic Immunotherapy | PMID: 23667569, PMID: 22437870 |
| DAP10 | T cell signaling | Antigen discovery, Fratricide Immunotherapy, Tolerogenic Immunotherapy | PMID: 23667569, PMID: 22437870 |
| ICOS, OX40, PD1, CTLA4, TIM3 | T cell signaling | Antigen discovery, Fratricide Immunotherapy, Tolerogenic Immunotherapy, Modulating exhaustion | PMID: 23667569, PMID: 22437870 |
| CD3zeta | T cell signaling | Antigen discovery, Fratricide Immunotherapy, Tolerogenic Immunotherapy | PMID: 23667569, PMID: 22437870 |
| Notch and synNotch | Synthetic domains | Antigen discovery, Immunomodulation, Vaccine boost, Modulating exhaustion | PMID: 26830878; U.S. Pat. No. 9,670,281 |
| Chemical-induced dimerization | Synthetic domains | Antigen discovery, Immunomodulation | PMID: 26431673 |
| CD79A, B | B cell signaling | Tolerogenic Immunotherapy, Immunomodulation, Vaccine boost | PMID: 21816833 |
| CD72 | B cell signaling | Tolerogenic Immunotherapy, Immunomodulation, Vaccine boost | PMID: 21816833 |
| CD22 | B cell signaling | Tolerogenic Immunotherapy, Immunomodulation, Vaccine boost | PMID: 21816833 |
| CD5 | B cell signaling | Tolerogenic Immunotherapy, Immunomodulation, Vaccine boost | PMID: 21816833 |
| CD19 | B cell signaling | Tolerogenic Immunotherapy, Immunomodulation, Vaccine boost | PMID: 21816833 |
| CD45 | B cell signaling | Tolerogenic Immunotherapy, Immunomodulation, Vaccine boost | PMID: 21816833 |
| Cytokines such as IL2, IL4, EPO, GM-CSF | Cytokine signaling | Tolerogenic Immunotherapy, Immunomodulation, Vaccine boost | PMID: 17934481; PMID: 10808165; PMID: 27317733 |
| JAK-STAT | Cytokine signaling | Tolerogenic Immunotherapy, Immunomodulation, Vaccine boost | PMID: 17934481; PMID: 10808165; PMID: 27317733 |
| Chemokines such as CCL10 | Cytokine signaling | Tolerogenic Immunotherapy, Immunomodulation, Vaccine boost | PMID: 24679437 |
| G protein coupled receptors | Cytokine signaling | Tolerogenic Immunotherapy, Immunomodulation, Vaccine boost | PMID: 24679437 |
| TNF Receptor superfamily | Cytokine signaling | Immunomodulation, Vaccine boost | PMID: 19239902 |
| NK cell receptors | Innate immune signaling | Immunomodulation, Vaccine boost | PMID: 20567250 |
| Fc Receptors | Innate immune signaling | Immunomodulation, Vaccine boost | PMID: 25045879 |
| Toll-like Receptors | Innate immune signaling | Immunomodulation, Vaccine boost | PMID: 15932016 |
| RIG-I-like receptors | Innate immune signaling | Immunomodulation, Vaccine boost | PMID: 21616437 |
| NOD-like receptors | Innate immune signaling | Immunomodulation, Vaccine boost | PMID: 26632377 |

In some embodiments, any of the options in table 0.1 can be combined with any of the options in table 0.2 and with any of the options in table 0.3. In some embodiments, any of the options in tables 0.1-0.3 can be combined with any antigen presenting domain (MHC I or MHC II or binding domain thereof). In some embodiments, any of the SABRs provided herein can have any of the components provided in tables 0.1-0.3 in it.

Some embodiments provided herein relate to a SABR comprising a transmembrane domain.

Some embodiments provided herein relate to a SABR comprising a transmembrane domain, wherein the transmembrane domain comprises a transmembrane domain from one or more of 4-1BB (CD137), CD28, CD27, DAP10, ICOS, OX40, PD1, CTLA4, TIM3, CD3zeta, Notch, syn-Notch, chemical-induced dimerization, CD79A, CD79B, CD72, CD22, CD5, CD19, CD45, IL2, IL4, EPO, GM-CSF, JAK-STAT, CCL10, a G protein coupled receptor, a receptor of the TNF Receptor superfamily, a NK cell receptor, a Fc receptor, a toll-like receptor, a RIG-I-like receptor, or a NOD-like receptor, or a MHC molecule. Some embodiments provided herein relate to a SABR comprising a transmembrane domain, wherein the transmembrane domain comprises a transmembrane domain from one or more of PMID: 23667569, PMID: 22437870, PMID: 23667569, PMID: 22437870, PMID: 23667569, PMID: 22437870, PMID: 23667569, PMID: 22437870, PMID: 23667569, PMID: 22437870, PMID: 26830878, U.S. Pat. No. 9,670,281, PMID: 26431673, PMID: 21816833, PMID: 17934481, PMID: 10808165, PMID: 27317733, PMID: 17934481, PMID: 10808165, PMID: 27317733, PMID: 24679437, PMID: 19239902, PMID: 20567250, PMID: 25045879, PMID: 15932016, PMID: 21616437, or PMID: 26632377. Some embodiments provided herein relate to a SABR comprising a transmembrane domain, wherein the transmembrane domain comprises a transmembrane domain from one or more of the domains of Table 0.3.

Some embodiments provided herein relate to a SABR comprising: an antigen presenting domain, a signal transduction domain, wherein the antigen presenting domain comprises a binding fragment of a MHC molecule, and a transmembrane domain, wherein the transmembrane domain comprises any one or more of the transmembrane domains of Tables 0.1, 0.2, or 0.3.

Some embodiments provided herein relate to a SABR comprising: an antigen presenting domain, and a signal transduction domain, wherein the antigen presenting domain comprises a binding fragment of a MHC molecule, wherein the antigen presenting domain comprises any one or more of the antigen presenting domains of Tables 0.1, 0.2, or 0.3.

Some embodiments provided herein relate to a SABR comprising: an antigen presenting domain, and a signal transduction domain, wherein the antigen presenting domain comprises a binding fragment of a MHC molecule, and wherein the signal transduction domain comprises any one or more of the signal transduction domains of Tables 0.1, 0.2, or 0.3.

Some embodiments provided herein relate to a SABR wherein the antigen presenting domain is fused to the signal transduction domain. In some embodiments, the MHC portion of the SABR includes some or all of a MHC. In some embodiments, the MHC is a human MHC. In some embodiments, the MHC includes one or more or all of the conserved sequences of the MHC (e.g., the conserved residues within any one of FIGS. 20A-20F.

Some embodiments provided herein relate to a SABR comprising one or more linkers.

Cell Compositions

Each of the embodiments provided herein with regard to Signaling and Antigen-Presenting Bifunctional Receptors (SABRs) can be used within the present embodiments described herein with regard to Cell Compositions.

Some embodiments provided herein relate to a cell comprising: an extracellular peptide-MHC complex comprising: an antigen presenting domain linked to a signal transduction domain, wherein the antigen presenting domain comprises an MHC molecule.

Some embodiments herein relate to a cell comprising any of the SABRs described herein. Some embodiments herein relate to a cell comprising a SABR comprising: an antigen presenting domain, and a signal transduction domain, wherein the antigen presenting domain comprises a binding fragment of a MHC molecule. Some embodiments herein relate to a cell comprising any of the SABRs described herein, wherein the antigen presenting domain comprises a MHC. Some embodiments herein relate to a cell comprising any of the SABRs described herein, wherein the MHC comprises a Class I MHC. Some embodiments herein relate to a cell comprising any of the SABRs described herein, wherein the MHC comprises a Class II MHC. Some embodiments herein relate to a cell comprising any of the SABRs described herein, the SABR further comprising a peptide, wherein the peptide comprises an epitope, wherein the peptide epitope is covalently linked to the SABR, and wherein the antigen presenting domain binds to the peptide. Some embodiments herein relate to a cell comprising any of the SABRs described herein, wherein the signal transduction domain comprises a T cell signaling domain. Some embodiments herein relate to a cell comprising any of the SABRs described herein, the SABR further comprising a transmembrane domain. Some embodiments herein relate to a cell comprising any of the SABRs described herein, the SABR further comprising a transmembrane domain comprising any one or more of the transmembrane domains of Tables 0.1, 0.2, or 0.3. Some embodiments herein relate to a cell comprising any of the SABRs described herein, wherein the antigen presenting domain comprises any one or more of the antigen presenting domains of Tables 0.1, 0.2, or 0.3. Some embodiments herein relate to a cell comprising any of the SABRs described herein, wherein the signal transduction domain comprises any one or more of the signal transduction domains of Tables 0.1, 0.2, or 0.3. Some embodiments herein relate to a cell comprising any of the SABRs described herein, wherein the antigen presenting domain is fused to the signal transduction domain. Some embodiments herein relate to a cell comprising any of the SABRs described herein, the SABR further comprising one or more linkers.

Some embodiments herein relate to a cell comprising any of the SABRs described herein, wherein the cell is sourced from any T cell line such as Jurkat cells, NFAT-GFP-Jurkat cells. Some embodiments herein relate to a cell comprising any of the SABRs described herein, wherein the cell is sourced from primary T cells from a patient or healthy donors or Natural Killer cells. Some embodiments herein relate to a cell comprising any of the SABRs described herein, wherein the cell is sourced from regulatory T cells, dendritic cells, B cells, macrophages, or Natural Killer cells.

Nucleic Acid Encoding

Each of the embodiments provided herein with regard to Signaling and Antigen-Presenting Bifunctional Receptors can be used within the present embodiments described herein with regard to Nucleic Acid Encoding.

Some embodiments herein relate to an isolated nucleic acid molecule comprising a nucleotide sequence encoding any one of the SABRs described herein. Some embodiments herein relate to an isolated nucleic acid molecule comprising a nucleotide sequence encoding any one of the SABRs described herein, the SABR comprising: an antigen presenting domain, and a signal transduction domain, wherein the antigen presenting domain comprises a binding fragment of a MHC molecule. Some embodiments herein relate to an isolated nucleic acid molecule comprising a nucleotide sequence encoding any one of the SABRs described herein, wherein the antigen presenting domain comprises a MHC. Some embodiments herein relate to an isolated nucleic acid molecule comprising a nucleotide sequence encoding any one of the SABRs described herein, wherein the MHC comprises a Class I MHC. Some embodiments herein relate to an isolated nucleic acid molecule comprising a nucleotide sequence encoding any one of the SABRs described herein, wherein the MHC comprises a Class II MHC. Some embodiments herein relate to an isolated nucleic acid molecule comprising a nucleotide sequence encoding any one of the SABRs described herein, the SABR further comprising a peptide, wherein the peptide comprises an epitope, wherein the peptide epitope is covalently linked to the SABR, and wherein the antigen presenting domain binds to the peptide. Some embodiments herein relate to an isolated nucleic acid molecule comprising a nucleotide sequence encoding any one of the SABRs described herein, wherein the signal transduction domain comprises a T cell signaling domain. Some embodiments herein relate to an isolated nucleic acid molecule comprising a nucleotide sequence encoding any one of the SABRs described herein, the SABR further comprising a transmembrane domain. Some embodiments herein relate to an isolated nucleic acid molecule comprising a nucleotide sequence encoding any one of the SABRs described herein, the SABR further comprising a transmembrane domain, wherein the transmembrane domain comprises any one or more of the transmembrane domains of Tables 0.1, 0.2, or 0.3. Some embodiments herein relate to an isolated nucleic acid molecule comprising a nucleotide sequence encoding any one of the SABRs described herein, wherein the antigen presenting domain comprises any one or more of the antigen presenting domains of Tables 0.1, 0.2, or 0.3. Some embodiments herein relate to an isolated nucleic acid molecule comprising a nucleotide sequence encoding any one of the SABRs described herein, wherein the signal transduction domain comprises any one or more of the signal transduction domains of Tables 0.1, 0.2, or 0.3. Some embodiments herein relate to an isolated nucleic acid molecule comprising a nucleotide sequence encoding any one of the SABRs described herein, wherein the antigen presenting domain is fused to the signal transduction domain. Some embodiments herein relate to an isolated nucleic acid molecule comprising a nucleotide sequence encoding any one of the SABRs described herein, the SABR further comprising one or more linkers.

Methods for Signaling Cell Preparation

Each of the embodiments provided above with regard Signaling and Antigen-Presenting Bifunctional Receptors (SABRs) can be used within the present embodiments described herein with regard to Methods for Signaling Cell Preparation.

Some embodiments herein relate to a method for preparing a signaling cell. The method comprises: providing a target cell, and introducing into the target cell a nucleic acid molecule comprising a nucleotide sequence coding for an SABR directed against at least one T-cell receptor (TCR) expressed at the surface of a T-cell, wherein the SABR comprises a MHC linked to a signal transduction domain.

Methods for Antigen Discovery

Each of the embodiments provided above with regard Signaling and Antigen-Presenting Bifunctional Receptors (SABRs) can be used within the present embodiments described herein with regard to Methods for Antigen Discovery.

Antigen discovery refers to identifying one or more peptide sequences of a protein. In some embodiments, the identified antigens can be used in making vaccines for treatment of patients. In some embodiments, antigen receptor discovery refers to identifying one or more antigen receptors that recognizes a specific antigen. For example, antigen receptor discovery may comprise identifying one or more specific TCRs of a plurality of TCRs that recognize a specific antigen. In some embodiments, identified antigen receptors (e.g. TCRs) can be used for immunotherapy. In some embodiments, the SABRs described herein can be used for both antigen discovery and antigen receptor discovery.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cells producing the measurable signal, thereby identifying an antigen by associating the SABR in the cell with the reporter, with the antigen receptor.

Some embodiments herein relate to a method for antigen discovery, the method comprising: expressing any of the SABRs described herein in at least one reporter cell, wherein the at least one reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, identifying the at least one reporter cells producing the measurable signal, thereby identifying an antigen by associating the SABR in the cell with the reporter, with the antigen receptor, and identifying at least one peptide in the at least one reporter cell producing the measurable signal, thereby associating the peptide with the SABR with the antigen receptor.

FIG. 2A illustrates a schematic describing the use of SABRs in a reporter cell line that expresses a signal upon TCR signal transduction according to various embodiments herein. In some embodiments, for the use of SABRs 200 for antigen-discovery, TCR-cross-reactivity, and related approaches, SABRs 200 can be expressed in reporter cells 202 that produce a measurable signal upon signal transduction. An example of the use of SABRs 200 relies on a reporter cell line (e.g. NFAT-GFP-Jurkat cells), which express green fluorescent protein (GFP) upon T cell signal transduction. In some embodiments, T cells expressing a given TCR can be incubated with SABR-expressing, for example, NFAT-GFP-Jurkat cells. In some embodiments, the SABR-expressing cells can express GFP if a cognate antigen 204 presented by SABRs 200 is recognized by the T cells. In some embodiments, presentation of an irrelevant antigen 206, or an irrelevant TCR 208, by SABRs will not result in GFP expression, allowing identification of the SABRs 200 presenting the cognate antigen 204 by flow cytometry.

Figure 2B:
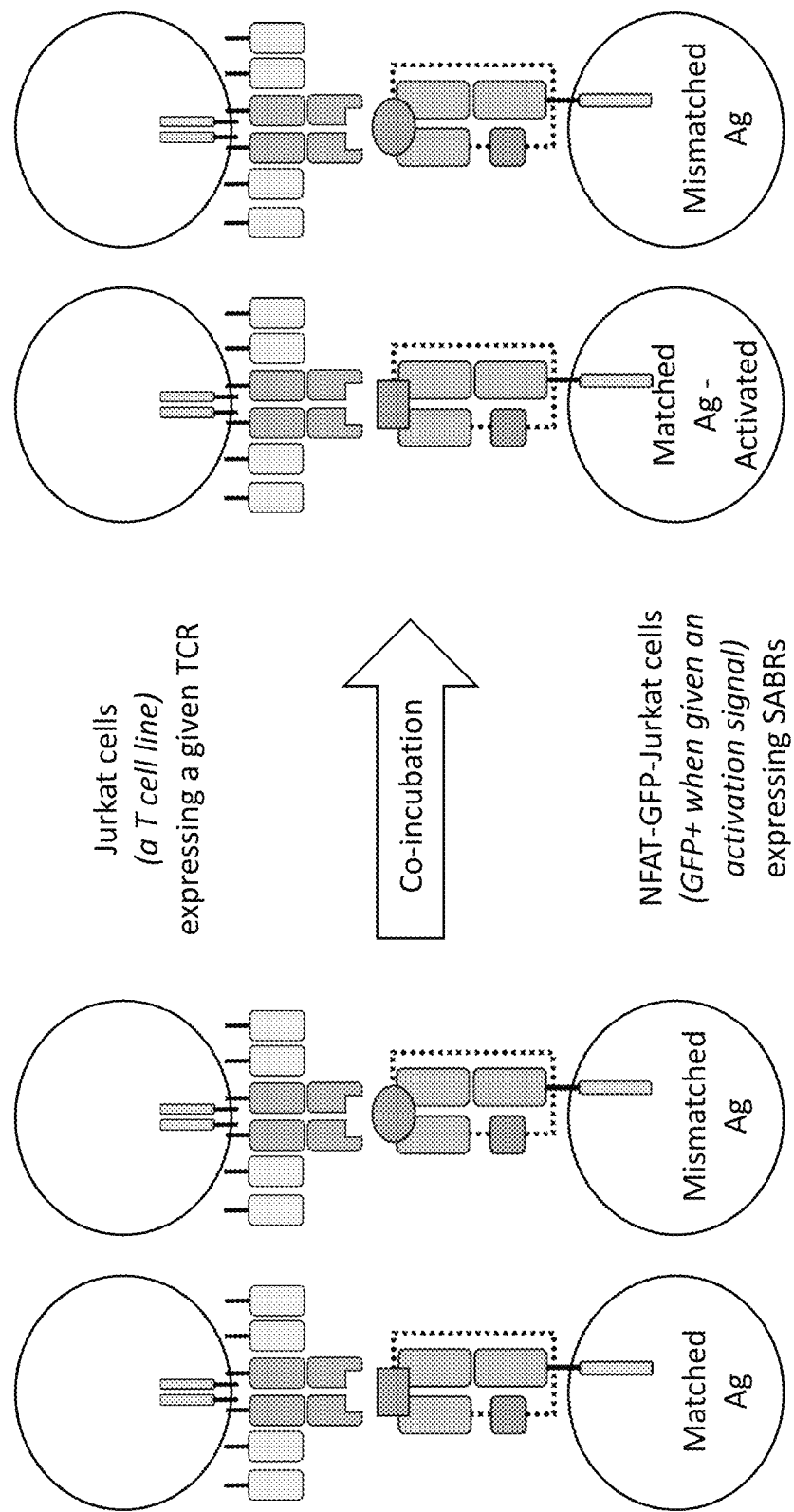
FIG. 2B illustrates a flowchart describing a process for antigen specific signaling by SABRs described herein.

FIG. 2B illustrates a flowchart describing a process for antigen specific signaling by SABRs described herein. Jurkat cells expressing a given TCR can be co-incubated with, for example, NFAT-GFP-Jurkat cells expressing SABRs. SABRs comprising matching antigens to the expressed TCR can activate upon recognition by the TCR, which can induce signaling with the NFAT-GFP-Jurkat cell. SABRs comprising mismatched or irrelevant antigens may not be recognized by the expressed TCR and may not activate.

Some embodiments herein relate to a method for antigen discovery, the method comprising: expressing any of the SABRs described herein in at least one reporter cell, wherein the at least one reporter cell produces a measurable signal upon a signal transduction event that occurs upon binding of an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor comprises a soluble molecule.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor comprises a soluble molecule, wherein the soluble molecule comprises an antibody.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor is expressed on a cell.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor is expressed on a cell, and wherein the antigen receptor comprises a TCR expressed on a T cell.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the at least one reporter cell comprises a library of cells, wherein the library of cells have numerous different SABRs, and wherein the numerous different SABRs can bind to different antigen receptors.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor comprises numerous antigen receptors Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein numerous different SABRs are expressed and one determines which SABR a particular antigen receptor binds to ("antigen discovery") by monitoring the measurable signal and identifying which SABR is in the cell that exhibited the measurable signal.

Some embodiments herein relate to a method for antigen discovery (and/or antigen receptor discovery), the method comprising: expressing any of the SABRs described herein in at least one reporter cell, wherein the reporter cell produces a measurable signal upon a signal transduction event that occurs upon binding of an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein more than one antigen receptor is present and one determines which antigen receptor binds to a particular SABR.

Some embodiments herein relate to a method for antigen discovery (and/or antigen receptor discovery_, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein more than one antigen receptor and more than one SABR are present.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the reporter cells comprise NFAT-GFP-Jurkat cells.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the reporter cells comprise NFAT-GFP-Jurkat cells, cells of any T cell line, cells of any B cell line, cells of any NK cell line, monocytic cell line, or myeloid cell line Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the measureable signal comes from expression of a detectable marker.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the reporter cells expressing the measurable signal are identified using flow cytometry.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor cells comprise cells expressing orphan T-cell receptors (TCR).

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the antigen receptor comprises an expressed orphan T-cell receptors (TCR).

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the at least one reporter cell expresses a genetically encoded antigen or antigenic epitope.

Some embodiments herein relate to a method for antigen discovery, the method comprising: expressing any of the SABRs described herein in at least one reporter cell, wherein the reporter cell produces a measurable signal upon a signal transduction event that occurs upon binding of a an antigen receptor to the antigen presenting domain, incubating the at least one reporter cell with an antigen receptor to be tested for binding to the SABR, detecting a presence of a measurable signal in the at least one reporter cell when the antigen receptor binds, and identifying the at least one reporter cell producing the measurable signal, thereby identifying an antigen by associating the SABR in the cell with the reporter, with the antigen receptor, wherein the at least one reporter cell expresses a genetically encoded antigen or antigenic epitope, and further comprising identifying the genetically encoded antigen or antigenic epitope by DNA sequencing.

Cell Libraries

Each of the embodiments provided herein with regard Signaling and Antigen-Presenting Bifunctional Receptors can be used within the present embodiments described herein with regard to Cell Libraries.

Some embodiments herein relate to a library comprising: any of the SABRs described herein, and at least one candidate antigen receptor.

Some embodiments herein relate to a library comprising: any of the SABRs described herein, and at least one candidate antigen receptor, wherein the at least one antigen receptor is expressed on a cell, wherein the cell is an antigen receptor cell. Some embodiments herein relate to a library comprising: any of the SABRs described herein, and at least one candidate antigen receptor, wherein the at least one antigen receptor is expressed on a cell, wherein the cell is a reporter cell.

Some embodiments herein relate to a library comprising: any of the SABRs described herein, and at least one candidate antigen receptor, wherein the at least one antigen receptor is expressed on a cell, wherein the SABR is expressed on a reporter cell, such that the cell provides a detectable marker upon binding of the SABR to the antigen receptor.

Some embodiments herein relate to a library comprising: any of the SABRs described herein, and at least one candidate antigen receptor, wherein the at least one antigen receptor is expressed on a cell, wherein the reporter cell comprises NFAT-GFP-Jurkat cells.

Some embodiments herein relate to a library comprising: any of the SABRs described herein, and at least one candidate antigen receptor, wherein the at least one antigen receptor is expressed on a cell, wherein the at least one antigen receptor is expressed on a cell, wherein the cell is an antigen receptor cell, and wherein the antigen receptor cell comprises T cells comprising TCR.

Some embodiments herein relate to a library comprising: any of the SABRs described herein, and at least one candidate antigen receptor wherein the at least one antigen receptor is expressed on a cell, wherein the cell is an antigen receptor cell, and wherein the antigen receptor cell comprises a cell expressing orphan TCR.

Figure 2C:
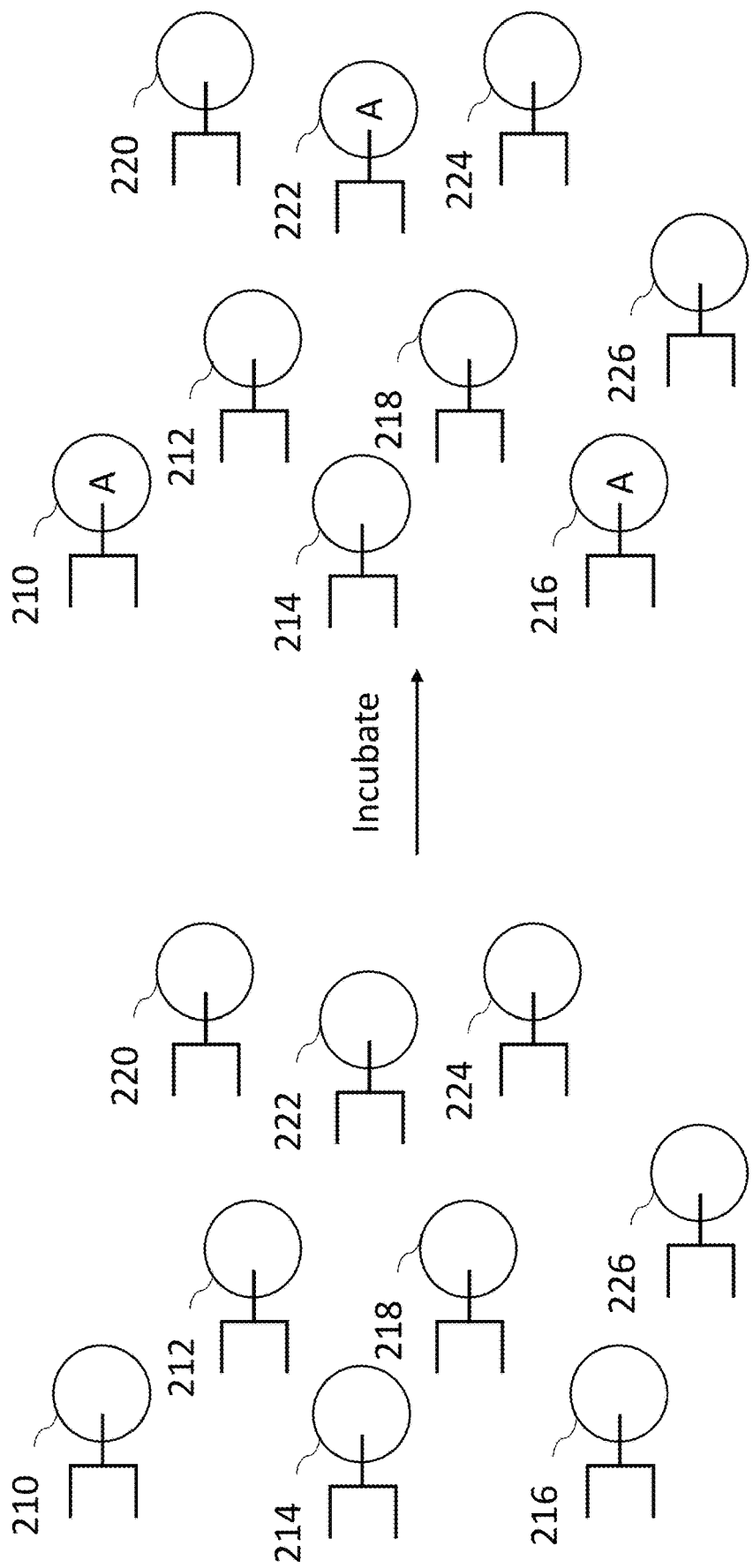
FIG. 2C illustrates a schematic demonstrating a use of a SABR library for antigen discovery according to various embodiments herein.

FIG. 2C illustrates a schematic demonstrating the use of a SABR library for antigen discovery according to various embodiments herein. In some embodiments, reporter cells, such as NFAT-GFP-Jurkat cells expressing a library of SABRs, can be used to uncover antigen specificities. In some embodiments, each cell 210, 212, 214, 216, 218, 220, 222, 224, and 226 in the SABR library expresses a unique genetically encoded antigen or antigenic epitope, which can be identified by DNA sequencing. In some embodiments, the SABR library can be co-incubated with T cells with unknown specificities, or T cell lines expressing a TCR with unknown specificity. In some embodiments, cells producing a signal, such as GFP+ cells 210, 216, and 222 can be sorted and the antigenic epitopes can be sequenced to determine the cognate antigen of the given T cell or TCR.

Therapeutic Methods

Each of the embodiments provided above with regard Signaling and Antigen-Presenting Bifunctional Receptors can be used within the present embodiments described herein with regard to Therapeutic Methods.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject. Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject, and wherein the therapeutic cell comprises CD8+ T cells, CD4+ T cells, Regulatory T cells, B cells, NK cells, Dendritic cells, Macrophages, Monocytes, or any hematopoietic cells including, for example hematopoietic stem cells, progenitors, lymphoid and myeloid cells.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject, and wherein the cellular response results in one or more of: cell mediated cytotoxicity, release of inflammatory cytokines, release of suppressive cytokines, direct suppression of target cells, release of anti-inflammatory cytokines, induction of pro-proliferative signals, induction of anti-proliferative signals, induction of apoptosis, induction of cell exhaustion markers, or direct target cell activation.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject, and wherein the therapeutic cell destroys a pathogenic T cell.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject, and wherein the therapeutic cell activates a target T cell.

Some embodiments herein relate to a method for initiating a therapeutic response, the method comprising: transducing a therapeutic cell with any one or more of the SABRs described herein, and administering the therapeutic cell to a subject in need of treatment, wherein the SABR directs a cellular response in the subject upon binding to an antigen receptor in the subject, and wherein the therapeutic cell suppresses a pathogenic T cell.

Some embodiments herein relate to a method for treating a patient comprising introducing into the patient a therapeutic T-cell comprising an extracellular peptide-MHC complex, the peptide-MHC complex comprising an antigen presenting domain linked to a signal transduction domain, wherein the antigen presenting domain comprises an MHC.

Therapeutic T Cell Compositions

Each of the embodiments provided herein with regard Signaling and Antigen-Presenting Bifunctional Receptors can be used within the present embodiments described herein with regard to Therapeutic T Cell Compositions.

Some embodiments herein relate to a composition comprising: a therapeutic T-cell comprising any of the SABRs described herein.

Additional SABR Compositions

Provided in this section are additional options for arrangements and combinations of SABRs and uses thereof.

Some embodiments herein relate to a SABR comprising: an extracellular binding domain comprising an MHC and a peptide epitope, a transmembrane domain, and a cytoplasmic signaling domain.

Cell-based Platform for T cell Antigen Discovery

Each of the embodiments provided herein with regard Signaling and Antigen-Presenting Bifunctional Receptors can be used within the present embodiments described herein with regard to a Cell-Based Platform for T cell Antigen Discovery.

Some embodiments herein relate to chimeric SABRs in a novel cell-based platform for TCR antigen discovery. In some embodiments, SABRs present an extracellular peptide-MHC complex and induce intracellular signaling via a TCR-like signal upon binding with a cognate TCR. Some embodiments herein relate to antigen discovery using SABR libraries to screen, for example, thousands of antigenic epitopes. This platform was verified by identifying the targets recognized by public TCRs of known specificities. Moreover, this approach can be extended for personalized neoantigen discovery. In some embodiments, the antigen discovery platform described herein can provide a scalable and versatile way to develop novel targets for immunotherapy.

A CD8+ T cell encodes a unique surface T Cell Receptor (TCR) that recognizes 8-12 residue long peptide epitopes presented on class I MHC molecules, also known as Human Leukocyte Antigens (HLA) in humans. When a TCR complex binds cognate peptide-MHC (pMHC), the CD3ζ chains associated with the TCR complex dimerize to initiate downstream signaling. Multiple signaling cascades are activated, leading to rapid gene expression driven by the transcription factors NF-κB, AP-1, and NFAT7. In CD8+ T cells, TCR signaling induces expression of early activation markers (CD69 and CD107a), release of cytotoxic granules, and secretion of cytokines (IFNγ, IL2, and TNFα), ultimately killing the target cell. The interaction of cognate TCR and pMHC complexes generates a high degree of specificity towards a target antigen. T cells can recognize epitopes presented by tumor cells and infiltrate the tumor microenvironment. Antitumor T cells respond to two kinds of tumor-derived epitopes: 1) Public or private epitopes originating from non-mutated, tissue specific antigens or cancer-testis antigens, and 2) Private neoantigens originating from non-synonymous mutations. Both endogenous antigens and neoantigens can be used to provide targets of immunotherapies.

One of the bottlenecks in the field of tumor immunology is the identification of the antigen recognized by a particular antitumor CD8+ T cell. Several techniques have been developed to identify cognate antigens for T cells. The most common approach uses pMHC multimers to identify antigen-specific T cells by flow cytometry. However, antigen discovery using pMHC multimers requires ab initio knowledge of the antigenic landscape, is not scalable beyond $10^3$ antigens, but can identify multiple antigenic specificities simultaneously. This approach has been used to discover public tumor antigens as well as private neoantigens. One approach uses degenerate libraries of covalently linked. Following multiple rounds of selection, outgrowth, sequencing, and referencing tumor exome data, the cognate antigen of the TCR is identified. However, this approach is technically challenging because of the requirement of soluble TCR, does not represent the physiological TCR-pMHC interaction, but is antigen-agnostic and scalable to 106-108 epitopes. These limitations underscore the need for new techniques for T cell antigen discovery.

Some embodiments herein thus relate to novel antigen discovery techniques to address the unmet need. In some embodiments, cell-based platforms for T cell antigen discovery are presented. In some embodiments, by combining antigen presentation by pMHC complexes with intracellular signaling, SABRs allow identification of a successful TCR-pMHC interaction. Some embodiments relate to TCR antigen discovery using SABR libraries and its use for known public TCRs. Some embodiments relate to adaptation of SABR libraries for a personalized neoantigen-directed approach. Some embodiments describe a flexible and scalable method for T cell antigen discovery.

Additional Contemplated Embodiments

Each of the embodiments provided above with regard Signaling and Antigen-Presenting Bifunctional Receptors can be used within the present embodiments described herein with regard to Additional Contemplated Embodiments.

Various embodiments described herein address the limitations of the TCR-Antigen-MHC interaction through the introduction of SABRs. The use of SABRs, as discussed herein, allows for the utilization of TCR-Antigen-MHC interactions for various functions.

In some embodiments, a function enabled by the SABRs disclosed herein comprises uncovering T cell antigenic specificities in cancers, infectious diseases, and autoimmune diseases. T cell-mediated responses to cancers target multitude of antigens expressed on cancer cells. Knowing the antigens that are targeted is immensely useful for immunotherapy approaches to treat cancers. There are several technologies to uncover epitopes that are targeted by T cells. The most widely used technologies are based on using MHC-peptide-multimers. The use of MHC multimers has several drawbacks—it is labor intensive and not easily scalable, it is not trivial for class II MHC-peptide complexes, and it is not sensitive towards low-affinity interactions. Yeast display has also been tested for TCR antigen discovery but suffers from several drawbacks as well. Yeast display relies on using peptide-MHC-b2microglobulin single chain trimers (SCTs), which mimic antigen presentation and link the antigen genetically to MHC. However, the use of SCT Yeast display technology requires production of soluble TCR molecules, which is not robust, and which cannot be scaled to multiple TCRs easily. Moreover, because yeast lacks endogenous MHC, the SCTs may not fold correctly and may not represent physiological TCR binding. Other technologies that are antigen-directed require prior knowledge of antigenic epitopes from patient samples, or that require expansion of patient T cells that may bias the antigen specificity, or that require large amounts of patient samples that may not be available. The SABR technology described here uses an unbiased approach that will use a library of target cells that are recognized by a given T cell or a TCR. SABRs allow scalability of this approach to, for example, over $10^6$ epitopes and virtually all MHC alleles, including class I and class II alleles, does not require soluble TCR production, allows for low-affinity TCR-pMHC interactions, and can be used without patient tumor samples.

In some embodiments, another function enabled by the SABRs disclosed herein comprises studying T cell receptor cross-reactivity and heteroclitic ligands. TCRs display considerable promiscuity in recognition of the variants of their cognate epitope. The study of TCR cross-reactivity is important to understand the safety and efficacy of a TCR or a T cell bearing a particular TCR. In cancer immunotherapy, the knowledge of the cross-reactivity of a TCR can help understand the off-target or on-target, but unintended effects of using that TCR therapeutically without undesirable side effects. In immunotherapy for viruses such as HIV, the knowledge of TCR cross-reactivity can help understand the propensity of immune escape of the pathogen from that TCR. The current technologies of studying TCR cross-reactivity are based either on low-throughput methods using individual variant peptides, or on yeast display technologies that are laborious and require production of soluble TCRs. In some embodiments, the SABR technology described herein allows for construction of libraries of, for example, $10^3$-$10^6$ antigenic epitope variants for any given MHC-peptide combination, and for subsequent identification of variants that are recognized, without the requirement for soluble TCR production. In addition, this approach can be used to identify variants of a given epitope that may have different binding properties, such as heteroclitic ligands with higher affinity and antagonists.

In some embodiments, yet another function enabled by the SABRs disclosed herein comprises inducing specific T cell responses. Vaccination approaches that elicit T cell responses require presentation of antigen epitopes to T cells and subsequent stimulation of those T cells. Professional antigen presenting cells (APCs) process endogenous or foreign antigens and present them to T cells. Antigen-specific immunity can be elicited by using live attenuated or inactive viruses, soluble antigenic proteins, or by using vectors. However, in these approaches, the antigenic epitopes are processed by the natural cellular machinery, and hence there is no control over whether a given epitope will elicit a strong immune response. To elicit a response to a given epitope, it is expressed in APCs via expression cassettes for entire proteins of via tandem minigenes encoding epitopes. Single chain trimers can also be used to express a given MHC-peptide complex on APCs to elicit an immune response. As single chain trimers cannot signal in the APC, they cannot manipulate how the APC will stimulate T cells. In some embodiments, the SABRs described herein can be coupled to specific signaling molecules that can allow the APCs to secrete cytokines and activate T cells that recognize them. In some embodiments, SABRs can be configured to elicit immunosuppressive cytokines in APCs, which can cause suppression of particular responses.

In some embodiments, yet another function enabled by the SABRs disclosed herein comprises eliminating T cell specificities. Pathogenic T cell clonal specificities may play a central role in T cell leukemias and autoimmune disorders. In T cell leukemia, the outgrown and transformed clones can be specifically targeted based on the antigenic epitopes recognized by them. In autoimmune disorders, T cell clones that are autoreactive can also be targeted based on their cognate epitopes Eliminating T cell clones based on their antigenic specificities allows for precise targeting with minimal off-target effects. The approaches tested so far have relied on monoclonal antibodies that recognize particular TCR variable regions. Targeting specific TCR variable regions provides precision but does not allow for targeting TCRs that may comprise of different variable regions while recognizing the same antigenic specificity. In addition, this approach can result in depletion of all TCRs comprising of a given variable region without regard for their specificities. In some embodiments, SABRs can allow for targeting of TCRs based on their antigen specificity. T cells transduced with SABRs presenting a given epitope can be used therapeutically to eliminate pathogenic T cell specificities. In addition, the identification of antigens that can be recognized by clonal T cells can be used for developing SABRs even without the knowledge of their natural cognate antigen. In some embodiments, the drawbacks of existing technologies can be overcome by linking signaling and antigen presentations through SABRs. By combining antigen presentation and signaling, SABRs allow a robust, scalable, high-throughput, and sensitive approach to initiate signal transduction in cells recognized by given TCRs, therefore allowing a functional output to be generated by them.

In some embodiments, MHC molecules present peptide epitopes on a cell surface for recognition by T cells. In their native form, MHC molecules lack signaling domains, and cannot transduce any signal into the antigen presenting cell. Some embodiments described herein relate to a chimeric construct (e.g. SABR) that adds a signal transduction domain to the intracellular end of MHC molecules. In some embodiments, these SABRs are able to present antigen, and induce an intracellular signal upon recognition by a T cell. In some embodiments, SABRs have two or more distinct functional parts including, for example, including one or more antigen recognition domains that are based on MHC molecules, which present peptide epitopes to T cells. In some embodiments, these can either be genetically encoded and covalently linked to the MHC molecule or expressed in the cell and presented naturally by the MHC molecule. Additionally, in some embodiments, the SABRs comprise one or more signal transduction domains that induce an intracellular signal to induce a transcriptional response upon binding of the SABRs to their cognate T cells. The SABRs constructs can be used for multiple different purposes, such as for antigen-discovery in cancer, autoimmune disorders, and infectious diseases, for immunotherapeutic approaches to eliminate T cell specificities, for inducing antigen specific cytokine signaling.

Figure 3A:
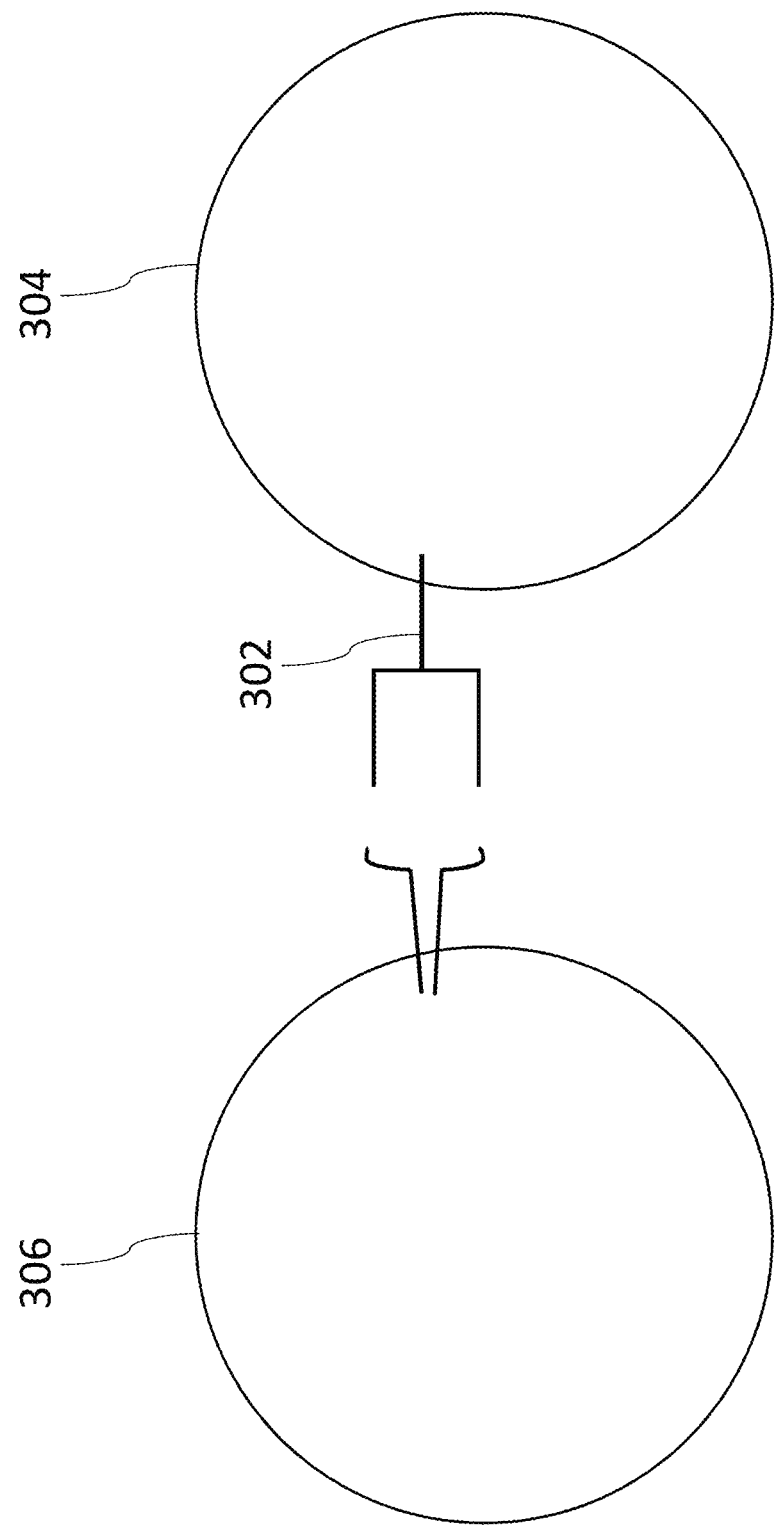
FIG. 3A illustrates a schematic of T cells and target cells used to demonstrate a function of SABRs according to various embodiments herein.

FIG. 3A illustrates a schematic of the T cells and target cells used to demonstrate the function of SABRs according to various embodiments herein. In some embodiments, class I SABRs 302 can be constructed based on the two constructs shown in FIG. 1C. These include the SCTR constructs, which consist of the peptide epitope covalently linked to MHC, and the SCDR constructs, which can, in some embodiments, be forced to present a peptide epitope that is not genetically linked to MHC. In some embodiments, the SCTR constructs can be constructed to express, for example, either A2-NYESO (a cancer-specific MHC-antigen combination) or B27-KK10 (an HIV-specific MHC-antigen combination). In some embodiments, the SCDR constructs for A2 and B27 can be constructed and a peptide can be used to present, for example, either NYESO or KK10 antigen. In some embodiments, for example, NFAT-GFP-Jurkats, can be transduced with the SCTR constructs or with SCDR constructs and pulsed with peptide antigen as reporter cells 304. In some embodiments, the reporter cells 304 can be transduced with Jurkat cells 306 expressing, for example, either A2-NYESO-specific TCR or B27-KK10-specific TCR, and the frequency of GFP+ cells can be measured with flow cytometry.

Figure 3B:
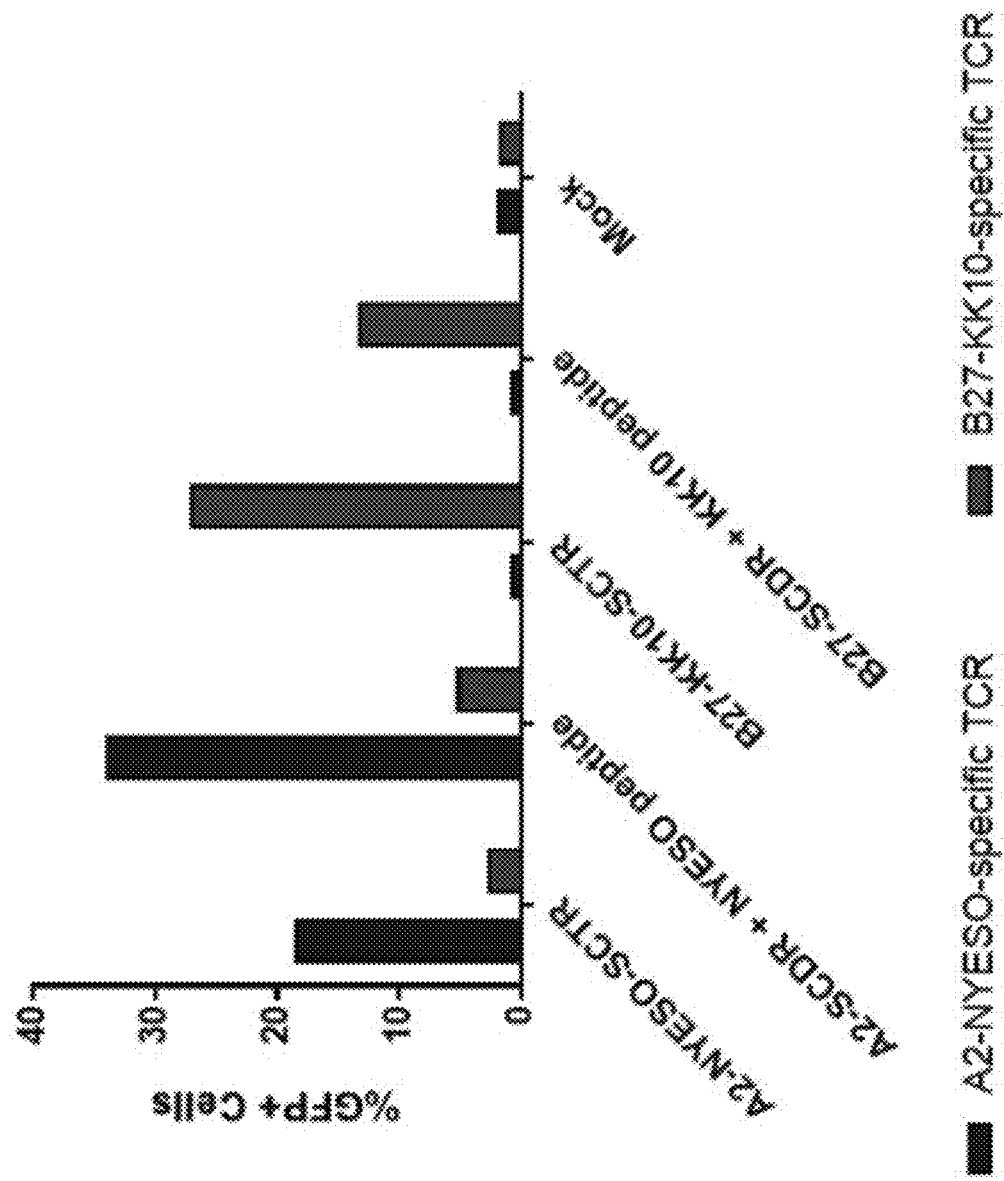
FIG. 3B illustrates a chart depicting measurement of GFP expression in SABR transduced reporter cells upon co-incubation with T cells expressing TCRs.
Figure 3C:
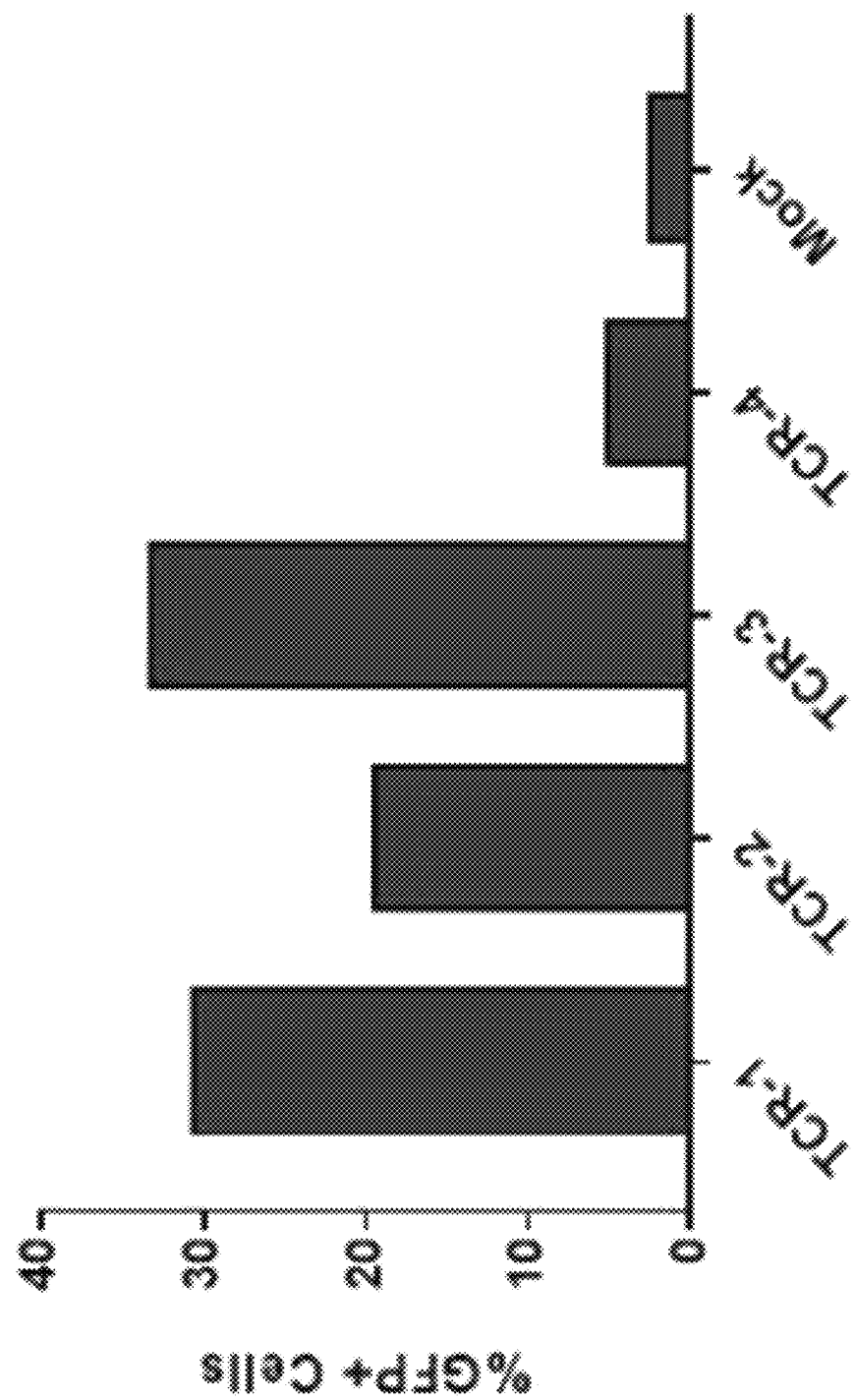
FIG. 3C illustrates a chart demonstrating a function of B27-KK10-SCTRs in response to four different TCRs from different patients.

As shown in FIG. 3B, NFAT-GFP-Jurkats may express GFP only upon specific recognition of MHC-antigen by SABRs. FIG. 3C illustrates a similar assay using NFAT- GFP-Jurkat cells expressing B27-KK10-SCTR constructs according to various embodiments. In some embodiments, Jurkat cells can be transduced with four different B27-KK10-specific TCRs from four different HIV patients and incubated them with the NFAT-GFP-Jurkat cells. As shown in FIG. 3C, the reporter cells can express GFP upon being recognized by all four TCRs. Therefore, in some embodiments, class I SABRs function in the proposed way discussed above and can be used in a reporter cell line.

Figure 4A:
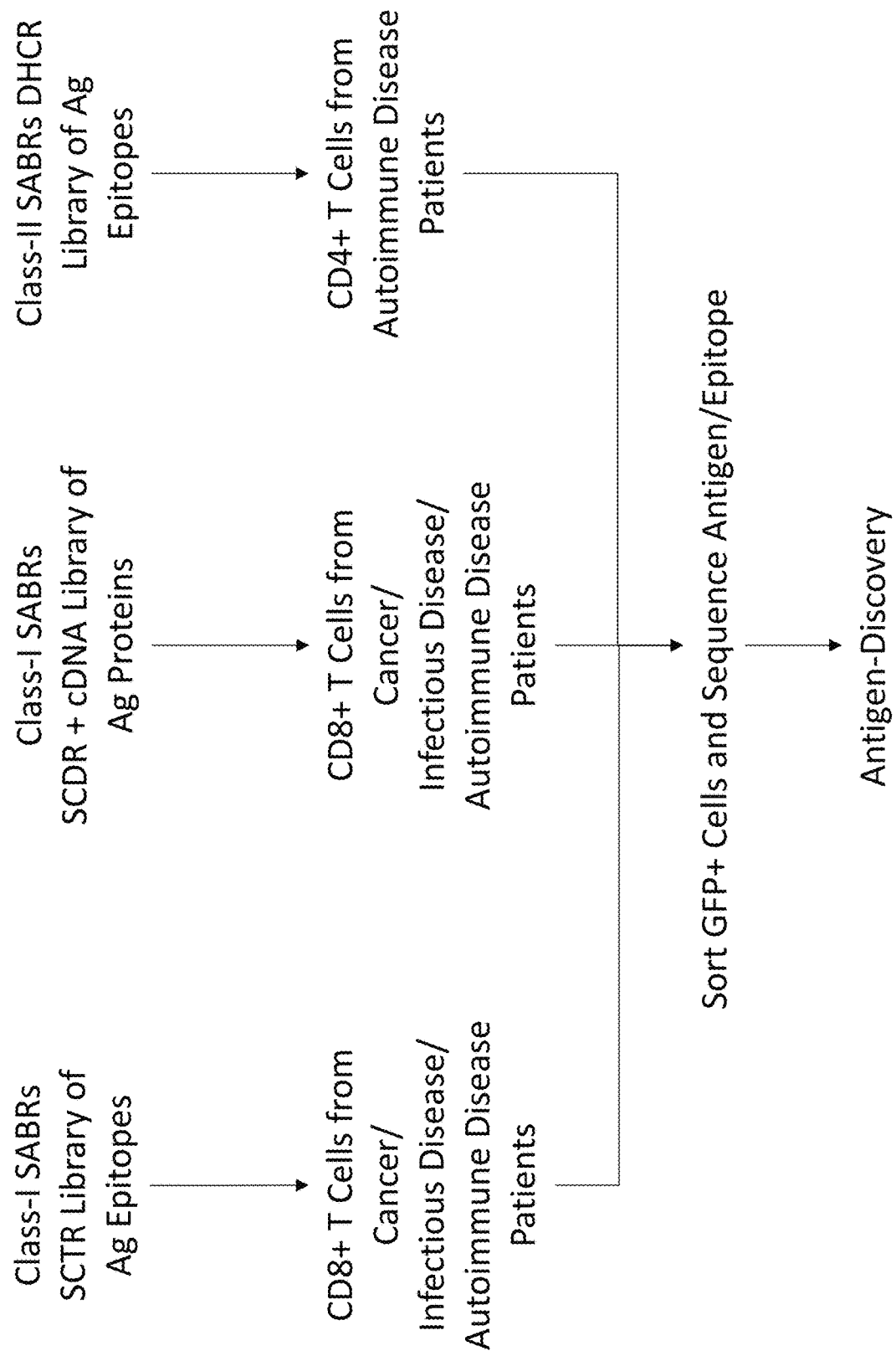
FIG. 4A illustrates a schematic describing a use of various SABR constructs for T cell antigen discovery according to various embodiments herein.
Figure 4B:
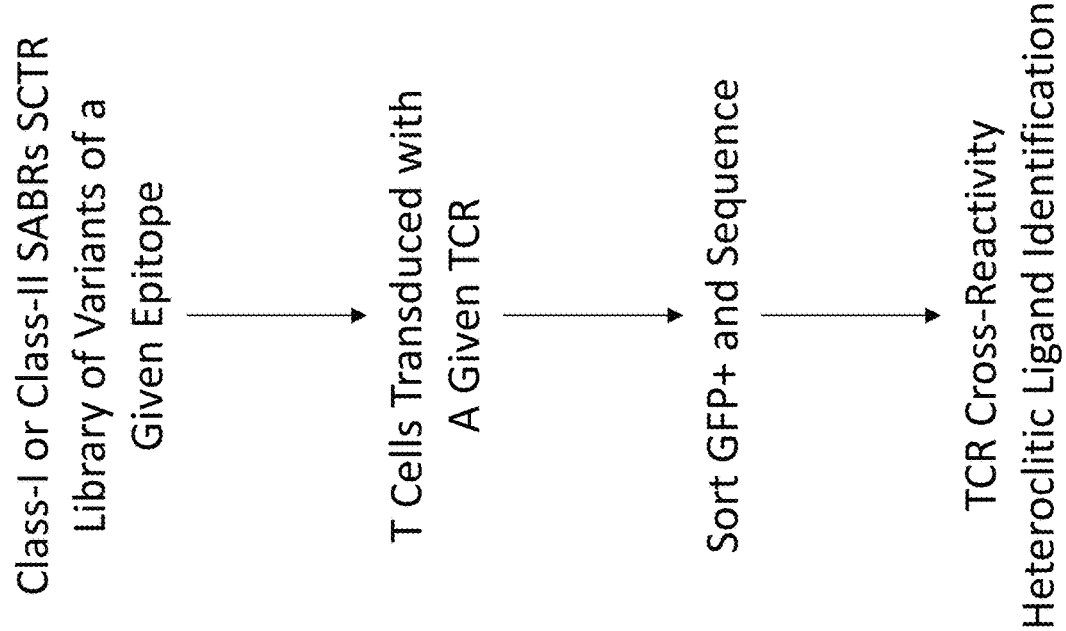
FIG. 4B illustrates a schematic describing a use of SCTRs to study TCR cross-reactivity or to identify heteroclitic ligands according to various embodiments herein.

FIG. 4A illustrates a schematic describing the use of various SABR constructs for T cell antigen discovery according to various embodiments herein. FIG. 4B illustrates a schematic describing the use of SCTRs to study TCR cross-reactivity or to identify heteroclitic ligands according to various embodiments herein. In some embodiments, using these approaches, the antigenic reactivities of cancer-specific, pathogen-specific, or autoreactive T cells can be identified. In some embodiments, SABR libraries expressing antigens or antigenic epitopes from cancers, pathogens, normal cellular proteome can be constructed. In some embodiments, these libraries can be used to identify T cell specificities in, for example, cancer immunity, in autoimmune disorders including diabetes and neurodegenerative disorders, in immunity against pathogens, and in vaccine responses (FIG. 4A). In some embodiments, for a given T cell specificity, SABR libraries expressing variants of the cognate epitope can be constructed and used to understand TCR cross-reactivity and to identify heteroclitic ligands (FIG. 4B).

Figure 5A:
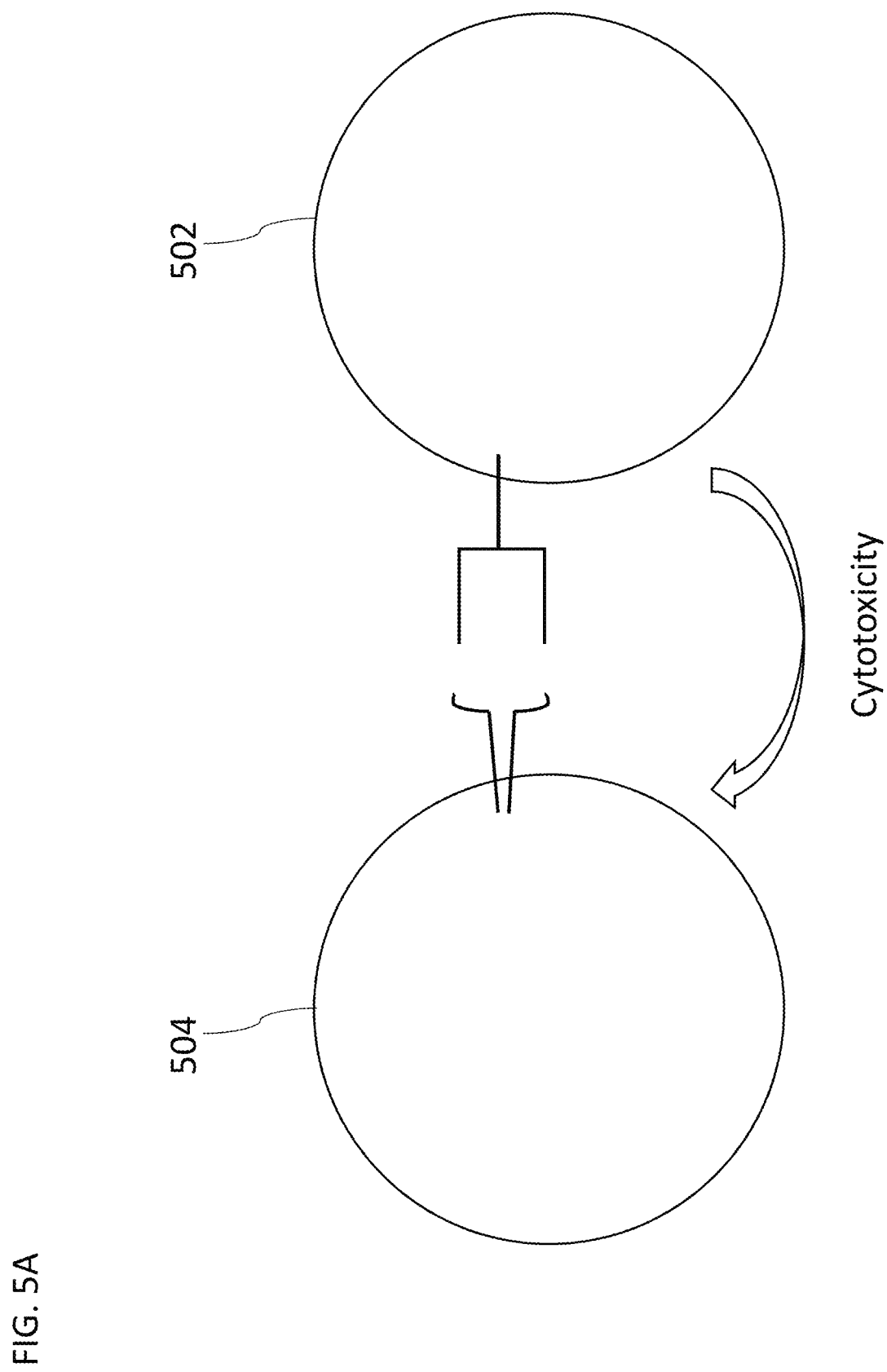
FIG. 5A illustrates a schematic describing an ability of SABRs to induce cytotoxicity in response to recognition of particular T cell antigenic specificities according to various embodiments herein.
Figure 5B:
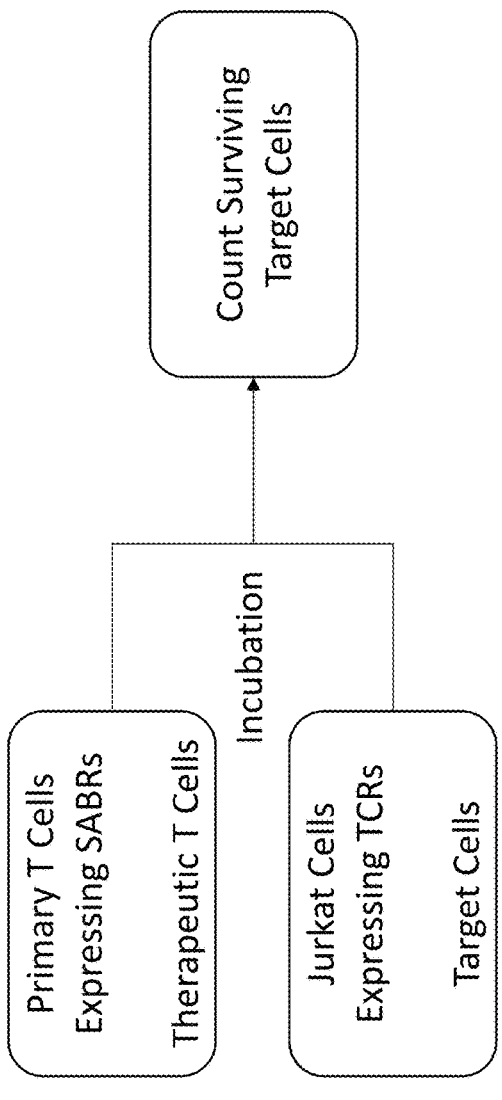
FIG. 5B illustrates a schematic describing a cytotoxicity assay used to test SABR-mediated cytotoxicity according to various embodiments herein.
Figure 5C:
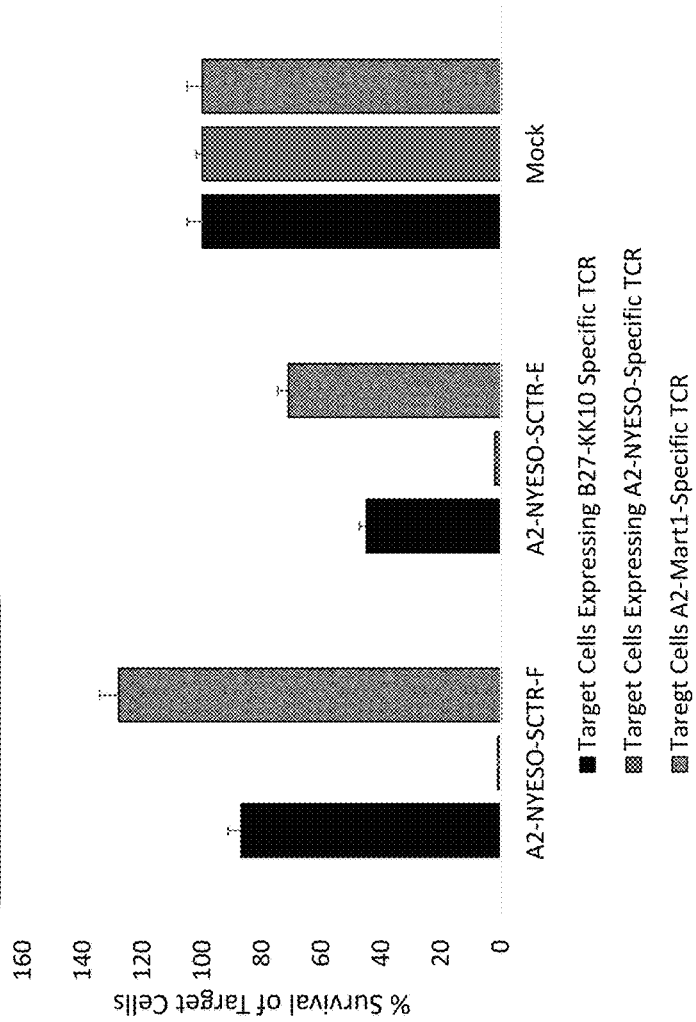
FIG. 5C illustrates a chart showing results demonstrating TCR specific cytotoxicity induced by A2-NYESO-SCTRs.

FIG. 5A illustrates a schematic describing the ability of SABRs to induce toxicity in response to recognition of particular T cell antigenic specificities according to various embodiments. In some embodiments, SABRs can also redirect T cell specificity to target other pathogenic T cells. As SABRs can induce signaling in T cells akin to CARs, they can be used to initiate a cytotoxic response towards T cells that recognize them. In some embodiments, a therapeutic T cell 502 transduced with SABRs recognizing a given antigen can be used to specifically eliminate pathogenic T cells 504 in a specific manner as described in FIG. 5A. In some embodiments, this ability can be tested using a cytotoxicity assay as described in FIG. 5B. In some embodiments, primary T cells can be transduced with two different A2-NYESO-SCTR constructs to allow their use as effector/therapeutic T cells. In some embodiments, Jurkat cells expressing A2-NYESO-, A2-MART1-, or B27-KK10-specific TCR can be used as target cells. In some embodiments, therapeutic T cells and target cells can be co-incubated and the survival of target cells can be measured after 24 hours. As described in FIG. 5B, A2-NYESO-SCTRs may be able to induce cytotoxicity specifically towards target cells expressing A2-NYESO-specific TCR, demonstrating the cytotoxic function of SABRs. In some embodiments, based on these results, SABRs can be used therapeutically to eliminate antigenic specificities from a T cell repertoire. In the case of, for example, autoimmune diseases, the pathogenic T cells may be autoreactive T cells, which can be recognized by the SABR expressing their cognate autoantigen. In the case of, for example, T cell leukemia, the pathogenic T cells may be clonally expanded T cells, which can be recognized by the SABR expressing either their cognate antigen or a heteroclitic ligand recognized by them. In some embodiments, the specificity of SABRs allows them to target particular T cell specificities while not targeting the normal T cell repertoire.

In summary, in various embodiments described herein, SABRs can be used as a robust, scalable, specific, and versatile way to couple antigen presentation and signaling. In various embodiments, this function can be exploited in several different ways to understand and manipulate T cell specificities.

In certain embodiments, SABRs can be used for antigen discovery. Current technologies for antigen discovery include MHC multimers, functional assays, yeast display, mass spectrometry, and DNA barcoding/NACS. These technologies have several disadvantages including a lack of scalability, lack of ability to expand to many MHC alleles, need for specialized instrumentation, and lack of robustness. Moreover, all the current technologies focus on cancer-specific T cells, and MHC-I antigens. There is a severe dearth of approaches/strategies to identify MHC-II antigens.

MHC multimers are produced by synthesizing peptide epitopes and re-folding them with biotinylated MHC molecules. However, MHC multimers are limited to 10-100 antigens at one time are therefore are not scalable. Moreover, making multimers for MHC-II antigens is technically challenging due to their inherent instability. Functional assays such as ELISPOT also rely on synthesizing peptide epitopes and presenting them on target cells. While it has been a popular technology, the scale up to include numerous MHC-I and MHC-II alleles, as well as a broad range of epitopes is complex. Yeast display techniques use MHC-peptide presentation on yeast cell surface followed by staining the yeast using a soluble TCR. Production of soluble TCRs is highly non-robust and time consuming, and therefore not easily scalable. Mass spectrometry techniques identify prospective antigenic epitopes based on mass spectrometry of antigen presenting cells. However, mass spectrometry requires a large amount of tissue, which is difficult to obtain for many diseases such as Type 1 Diabetes. Moreover, it also requires validation based on MHC multimers. Finally, DNA barcoding/NACS uses specialized barcoded MHC multimers that are immobilized on chips or beads. While effective, this technique is limited by the requirement for specialized equipment to capture cells and read their barcode, and by the inability to handle multiple sample at once.

Some embodiments herein are directed to novel technologies for discovering and validating antigen reactivity of T cells. T cells are an essential part of the adaptive immune system that fights infections and cancers. T cells use their surface TCR to recognize antigenic peptide epitopes presented by MHC proteins. Antigens displayed on MHC can be either from pathogens (e.g. peptides from Influenza virus), from cancerous cells (e.g. MART1/MelanA peptide expressed on Melanoma cells), or from normal cells (e.g. ProInsulin peptide from normal pancreatic cells). T cell responses are protective in their normal form but can be pathogenic if dysregulated.

T-cells are essential for immunity against viral infections and cancers but can cause autoimmune diseases like Type 1 Diabetes if they become dysfunctional. One of the biggest challenges in studying T cells is in the discovery of the specific protein antigens they recognize. In some embodiments, SABRs can be used to present protein antigens and induce a readable output of a T cell that recognizes them. In some embodiments, this ability of SABRs can solve the challenge of antigen identification and benefit the development of T cell mediated therapies. Some embodiments herein relate to using SABR technology for use in antigen discovery in numerous diseases including, for example, cancers, Type 1 Diabetes, multiple sclerosis, HIV/AIDS, and others. For example, FIG. 19 illustrates antigenic epitopes that, when combined with the SABR technology herein, could be useful in treatment of type 1 diabetes.

Protective cell responses, such as those towards pathogens or cancers, are manipulated for prevention/therapy via vaccines or immunotherapies. Dysfunctional T cell responses specific for autoantigens can be pathogenic, such as those targeting normal pancreatic cells in Type 1 Diabetes. Two types of T cells mediate the immune response: CD8+ T cells that recognize 8-12 residue long peptides presented on class I MHC (MHC-I) molecules and initiate direct killing of infected or cancerous cells, and CD4+ T cells that recognize 12-17 residue long peptides presented on class II MHC (MHCII) molecules and provide immunologic help to CD8+ T cells. Both CD8+ and CD4+ T cells play important roles in protective and pathogenic immunity. Understanding the antigens targeted by these cells is an important factor for manipulating these responses. There is a growing need for technologies to identify and validate targeted antigens.

Various embodiments herein are directed to novel technologies to identify and/or validate antigenic epitopes targeted by a given T cell. In some embodiments, the technology relies on synthetic proteins called SABRs.

In some embodiments, SABRs perform various functions including presenting an antigenic epitope via an extracellular MHC domain and initiating a readable cellular signal upon recognition of that epitope via an intracellular signaling domain. In some embodiments, by combining these two functions, SABRs can present an antigen, and then transduce a signal if a T cell recognizes that antigen. In some embodiments, the transduced signal is converted to a readable output, such as expression of a reporter gene, e.g. GFP, to mark a recognized cell.

In some embodiments, the various abilities of SABRs described herein can be used to screen for or validate reactivity to a given antigen, similar to ELISPOT assays. Example uses of this strategy according to various embodiments include monitoring vaccine/disease induced T cell responses in Influenza infection and screening for pathogenic autoreactive T cells in Type 1 Diabetes. Alternatively, in some embodiments, libraries of SABRs presenting numerous antigens can be constructed to identify antigens recognized by T cells of unknown specificity. Example uses of this strategy according to various embodiments include identification of tumor antigens recognized by tumor infiltrating lymphocytes and identification of neoantigen-specific T cell responses in cancer patients.

In accordance with various embodiments herein, The SABR technologies present major advantages over existing technologies including scalability, ease of use, ability to identify MHC-II antigens, and easier commercialization. Therefore, in some embodiments, SABR technology can be used into a commercial method or kit that can enable T cell antigen discovery, diagnostics, and validation for infectious diseases, cancers, and autoimmune diseases. In some embodiments, the SABR technology can be commercialized include pre-packaged lentiviral vectors to express SABRs and cell-based libraries expressing SABRs.

Advantages of SABR Technology

In some embodiments, the SABR library technology described herein has multiple advantages. In some embodiments, the SABR libraries described herein can be built at a flexible scale, from, for example, 1 to $10^6$ antigens or more, 100, 200, 300, 400, 1000, or more antigens in a library, depending on the disease in question. In some embodiments, the library can include hundreds of antigens for identifying a full protein's epitope, a couple of thousand antigens for diseases (neoantigen, listeria), or hundreds of thousands of antigens for broad identification Moreover, in some embodiments, this scale up/down can be performed in a standard immunology laboratory without the need for specialized equipment. SABR libraries can also be built for any given number of MHC alleles, making it easier to toggle between universal or patient-specific antigen libraries. Additionally, in some embodiments, the intended product and its use is in a format that requires routine laboratory procedures. Therefore, the turnaround time for using the product can be as low as 3-5 days. Furthermore, unlike yeast display or DNA barcoding, the SABR technology can be used on multiple samples at a time, increasing the throughput. Finally, in some embodiments, SABR libraries can be built for both MHC-I and MHC-II antigens, unlike the current technologies, which are restricted largely to MHC-I antigens. In some embodiments, this versatility allows the use of the SABR technology to a large number of autoimmune diseases.

In some embodiments, The SABR technology may have a significant cost advantage over other approaches. In some embodiments, the implementation of the technology does not require the use of any specialized equipment that a standard immunology laboratory would not have. For instance, in some embodiments, a flow cytometry-based cell sorter and access to Illumina sequencing facilities is sufficient to implement the technology in an academic/industrial laboratory. Current technologies are limited by the need for specialized equipment, for instance, access to Mass Spectrometer (MS), or specialized chips for DNA barcoding/NACS. Also, in some embodiments, unlike other technologies, the SABR technology does not require synthesizing any specialized reagents that are critical to its implementation. For example, yeast display technology requires synthesizing a soluble TCR, which is highly non-robust and requires time consuming/expensive protein purification. In some embodiments, SABRs are used in simple cell-based assays which can be performed in a general BSL2 laboratory setting. In some embodiments, the SABR technology offers a higher throughput because of its ability to process multiple samples at once. Most of the current technologies can handle only one patient sample at a time.

In some embodiments, the SABR technology can be manufactured on a mass scale. In some embodiments, the number of antigens that can be encoded in the library can be scaled up/down as per the requirements that are diseases/user specific. For example, a library for cancer neoantigens for patient-specific screening may encode for 6000 peptides, whereas a universal library for multiple class I HLA alleles may have ~$10^6$ peptides. In some embodiments, the scalability at this level is dependent on large scale oligonucleotide synthesis. In some embodiments, a given SABR library, for instance, can be around $10^5$-$10^6$ cells. In some embodiments, this number can be scaled up relatively easily, similar to commercially available cell lines.

Any one or more of the embodiments described herein can be combined with another one or more of the embodiments described below. Any one or more of the compositions described below can be combined or substituted into any one of the methods and/or mechanisms described below.

EXAMPLES

Example 1

SABRs, Peptide Fusion, Signaling Domain-MHC, MHC-Peptide Antigen

Figure 6A:
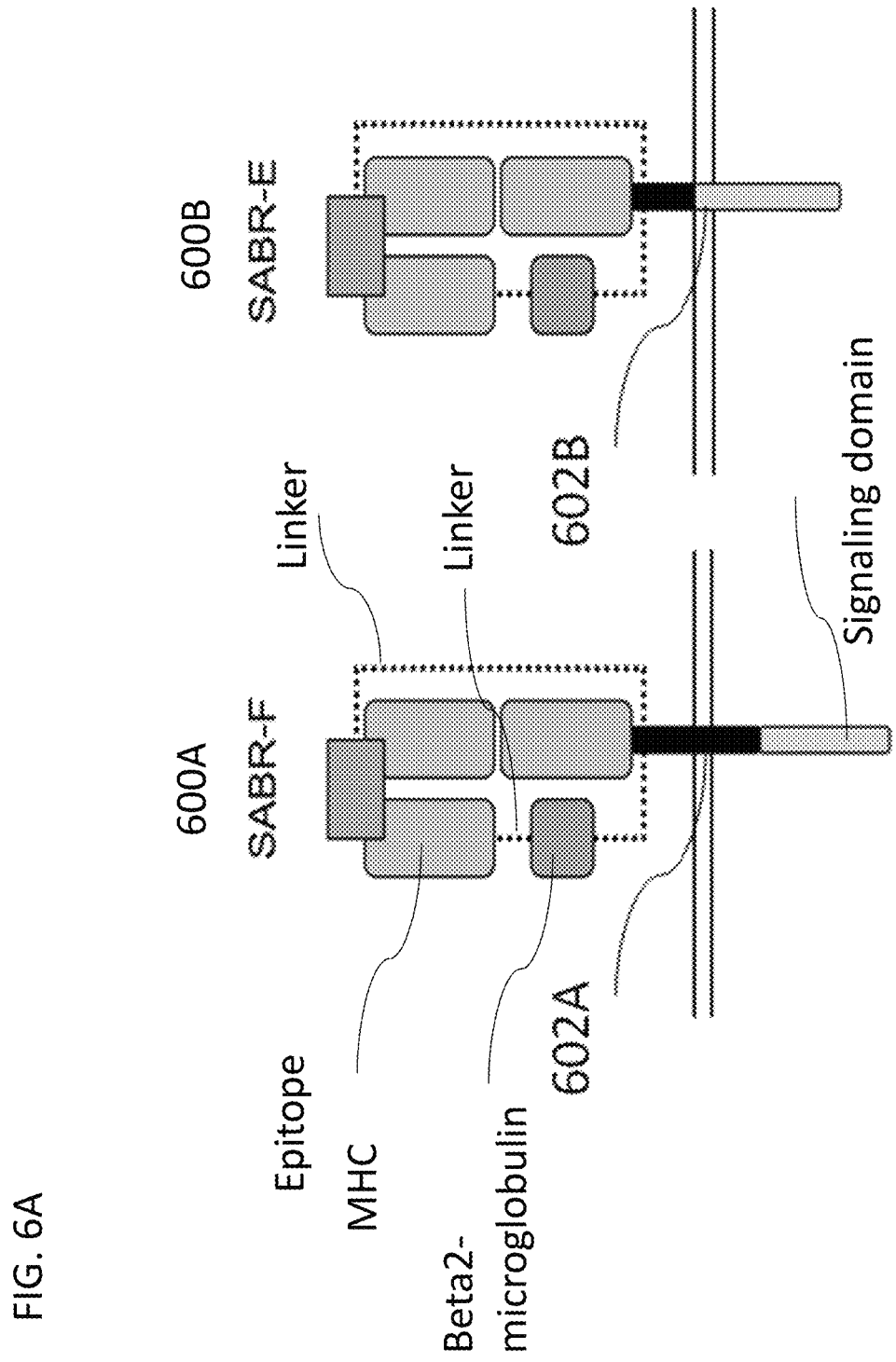
FIG. 6A illustrates schematics showing SABR-F and SABR-E constructs according to various embodiments herein.
Figure 6B:
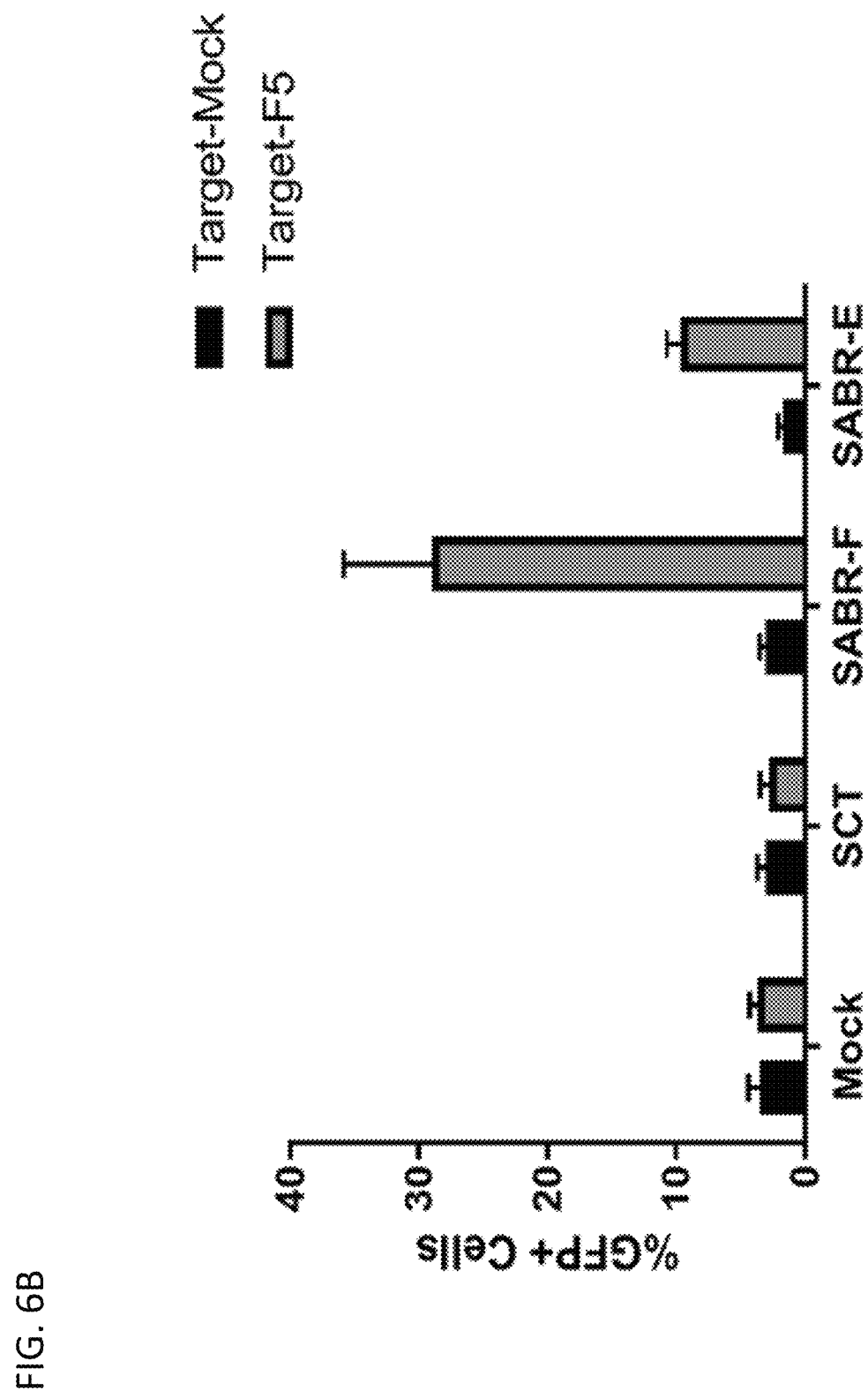
FIG. 6B illustrates a bar graph showing, on the Y-axis, % GFP+ cells at 8 hours in NFAT-GFP-Jurkats transduced with A2-MART1-SABRs and co-cultured with Jurkat cells transduced with TCRs.

T cell activation upon recognizing a target antigen induces detectable gene expression. However, as MHC molecules lack signaling domains, detection of recognized APCs is challenging. Fusing an intracellular signaling domain to pMHC complexes enables signal transduction. Chimeric receptors called SABRs were constructed. The extracellular domain of a SABR was a covalently linked peptide-β2microglobulin-MHC trimer, fused to an intracellular CD3ζ signaling domain with a CD28 co-stimulatory domain. Two variations of SABRs, SABR-F and SABR-E, were constructed which contained the entire MHC molecule or only the extracellular part of the MHC molecule respectively, as seen in FIG. 6A. FIG. 6A illustrates schematics showing the SABR-F and SABR-E constructs according to various embodiments. SABR-F 600A contains the transmembrane domain 602A from HLA, whereas SABR-E 600B contains the transmembrane domain 602B from CD3ζ. The two horizontal lines indicate two leaflets of the plasma membrane. FIG. 6B illustrates a bar graph showing, on the Y-axis, % GFP+ cells at 8 hours in NFAT-GFP-Jurkats transduced with A2-MART1-SABRs and co-cultured with Jurkat cells transduced with TCRs. Co-culture assays were performed using 50,000 target cells and 50,000 effector cells. Within FIG. 6B, bars indicate mean±sd, n=12.

Upon interaction with a TCR, SABRs presenting its cognate antigen can induce an intracellular signal. FIG. 7A illustrates schematics demonstrating SABRs and TCR-pMHC specific signaling, with single chain trimer (SCT) and antigen (Ag). Within FIG. 7A, dotted lines indicate Gly-Ser linkers. An SCT without a signaling domain will not induce an intracellular signal in an antigen presenting cell when recognized by a TCR. Similarly, a SABR presenting an irrelevant antigen will not induce an intracellular signal when recognized by a TCR. However, a SABR presenting a cognate antigen will induce an intracellular signal when recognized by a TCR.

Figures 7B, 7C:
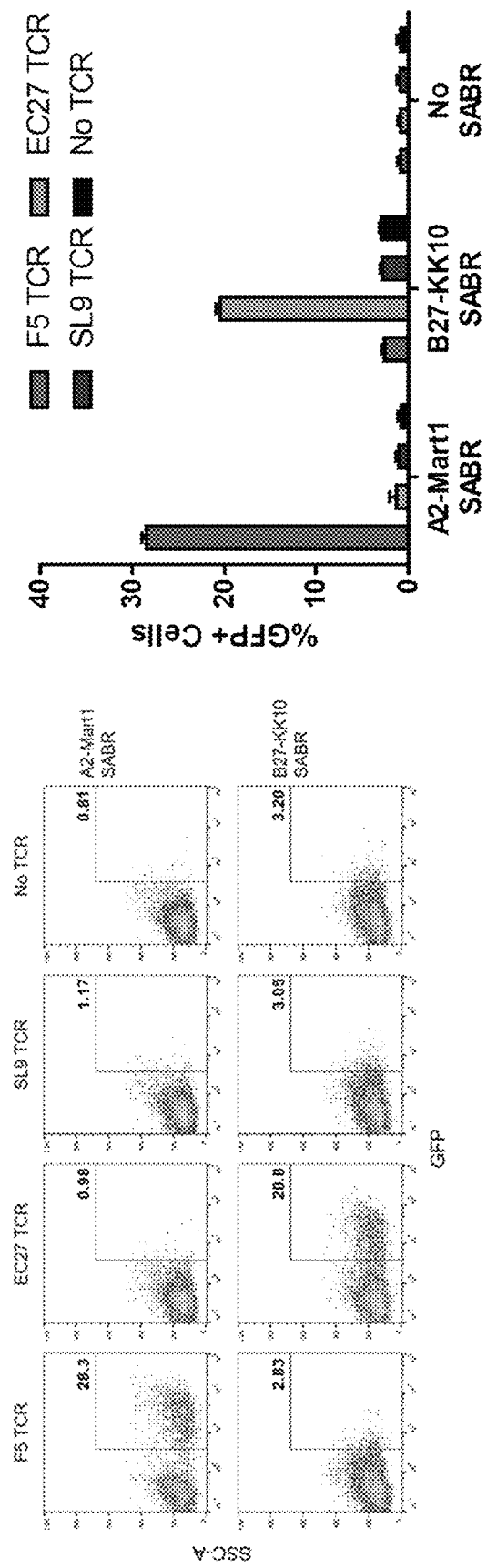
FIG. 7B illustrates representative flow cytometry plots from an experiment 8 hours from incubation.
FIG. 7C illustrates a bar graph of GFP expression by SABR transduced NFAT-GFP-Jurkat cells upon co-culture with TCR-transduced Jurkat cells.

To detect the signal induced by SABRs, NFAT-GFP-Jurkat cells were used, which express GFP upon receiving a signal via CD3ζ. NFAT-GFP-Jurkat cells were transduced with SABRs presenting the EAAGIGILTV epitope (from the MART1 protein) on HLA-A*0201 (hereafter known as A2-MART1-SABR) or the KRWIILGLNK epitope (KK10, from the HIV-1 Gag protein) from HIV-1 on HLA-B*2705 (hereafter known as B27-KK10-SABR). NFAT-GFP-Jurkat cells were co-incubated and transduced with Jurkat cells expressing TCRs and GFP expression was measured by flow cytometry after 8 hours. Specifically, F5 (recognizes A2-MART1), EC27 (recognizes B27-KK10), SL9 (recognizes A2-SLYNTVATL) TCRs or untransduced Jurkat cells were used. Robust GFP expression was detected only in co-culture assays with the cognate TCR-SABR-F pairs. FIG. 7C illustrates GFP expression by SABR transduced NFAT-GFP-Jurkat cells upon co-culture with TCR-transduced Jurkat cells. Within FIG. 7B, the Y-axis shows % GFP+ cells in co-culture assays performed with 10,000 effector and 10,000 target cells at 8 hours after co-culture. In FIG. 7C, bars indicate mean±sd, n=3. FIG. 7B illustrates representative flow cytometry plots from assays of FIG. 7C. Within FIG. 7B, frequency of GFP+ cells are indicated as a percentage.

The SABR-F construct showed higher signal than SABR-E construct, and therefore, was used for further experiments. To test if SABRs can detect T cell specificities in a polyclonal population, a number of Jurkat cells expressing F5 TCR were titrated with untranduced Jurkat cells and co-incubated them with NFAT-GFP-Jurkat cells expressing A2-MART1-SABR. SABR signaling was titratable and sensitive enough to detect at least as low as 10 F5+ Jurkat cells mixed with 10,000 mock-transduced Jurkat cells.

FIG. 7D illustrates a graph of detection of low cell numbers by SABRs. Within FIG. 7D, the Y-axis shows number of GFP+ cells in co-culture assays performed with 10,000 effector and 10,000 target cells at 8 hours after co-culture. The X-axis shows the number of F5+ Jurkat cells mixed with untransduced Jurkat cells. Within FIG. 7D, bars indicate values for n=1. FIG. 7E illustrates a timecourse of GFP expression by A2-MART1-SABR transduced NFAT-GFP-Jurkat cells co-cultured with F5-transduced Jurkat cells. The Y-axis shows % GFP+ cells in co-culture assays performed with 50,000 effector and 50,000 target cells. Within FIG. 7E, dots indicate mean±sd, n=3.

Figure 7F:
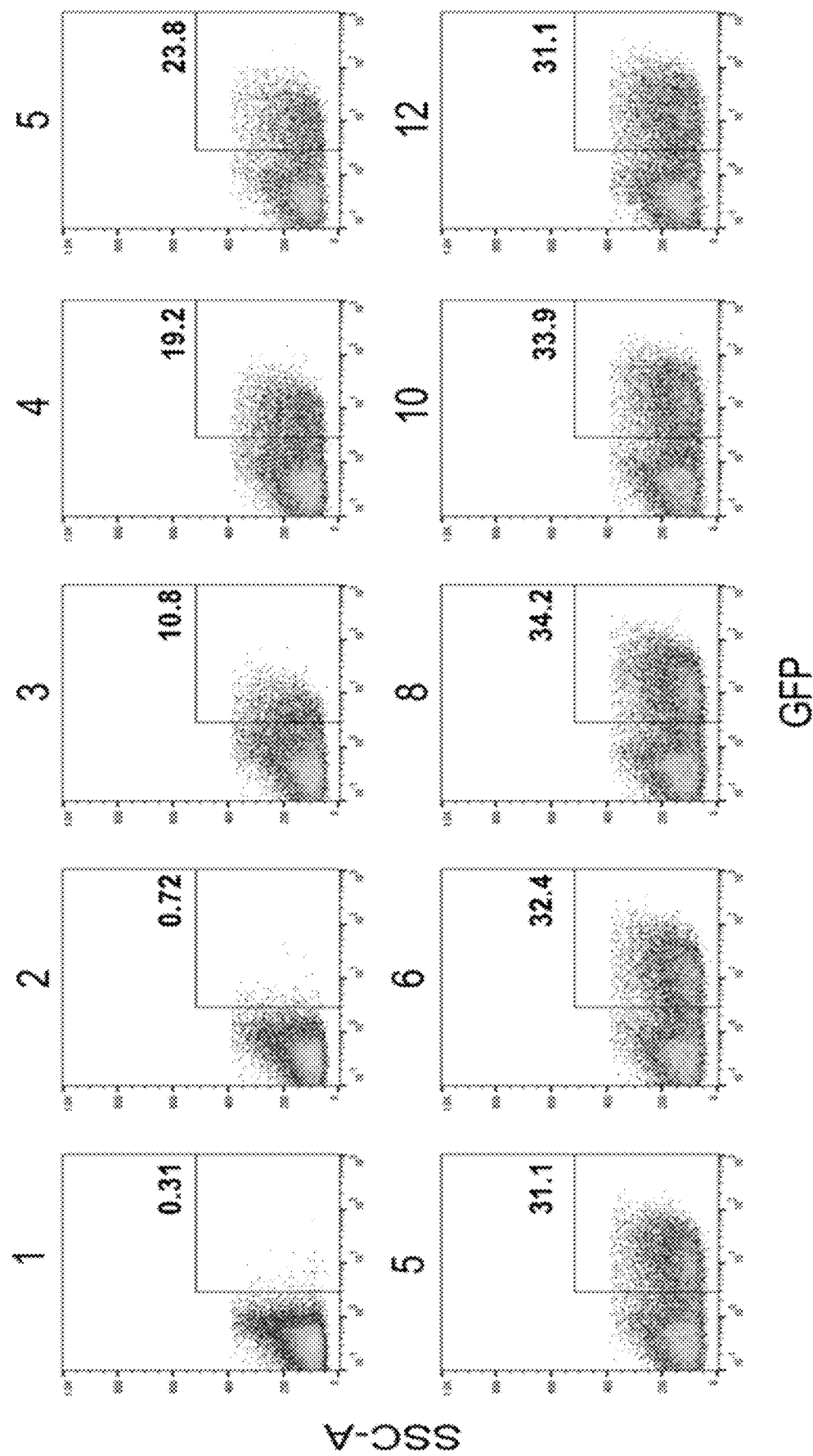
FIG. 7F illustrates representative flow cytometry plots from the experiment of FIG. 7E.

SABR signaling was also rapid, as GFP signal was detectable within 3 hours of co-incubation, and reached saturation within 6-8 hours, as shown in FIG. 7E and FIG. 7F. FIG. 7F illustrates representative flow cytometry plots from the experiment enumerated in FIG. 7E. Within FIG. 7F, the rectangle in the right bottom corners shows the gate for counting GFP+ cells. The time at which each sample was collected is shown as hours. The frequency of cells in the GFP+ gate is indicated as a percentage.

Taken together, these results show that SABRs can induce signaling upon successful and specific TCR-pMHC interaction, allowing identification of recognized APCs.

Example 2

SABRs Allow Different Modes of Antigen Presentation

Figure 8A:
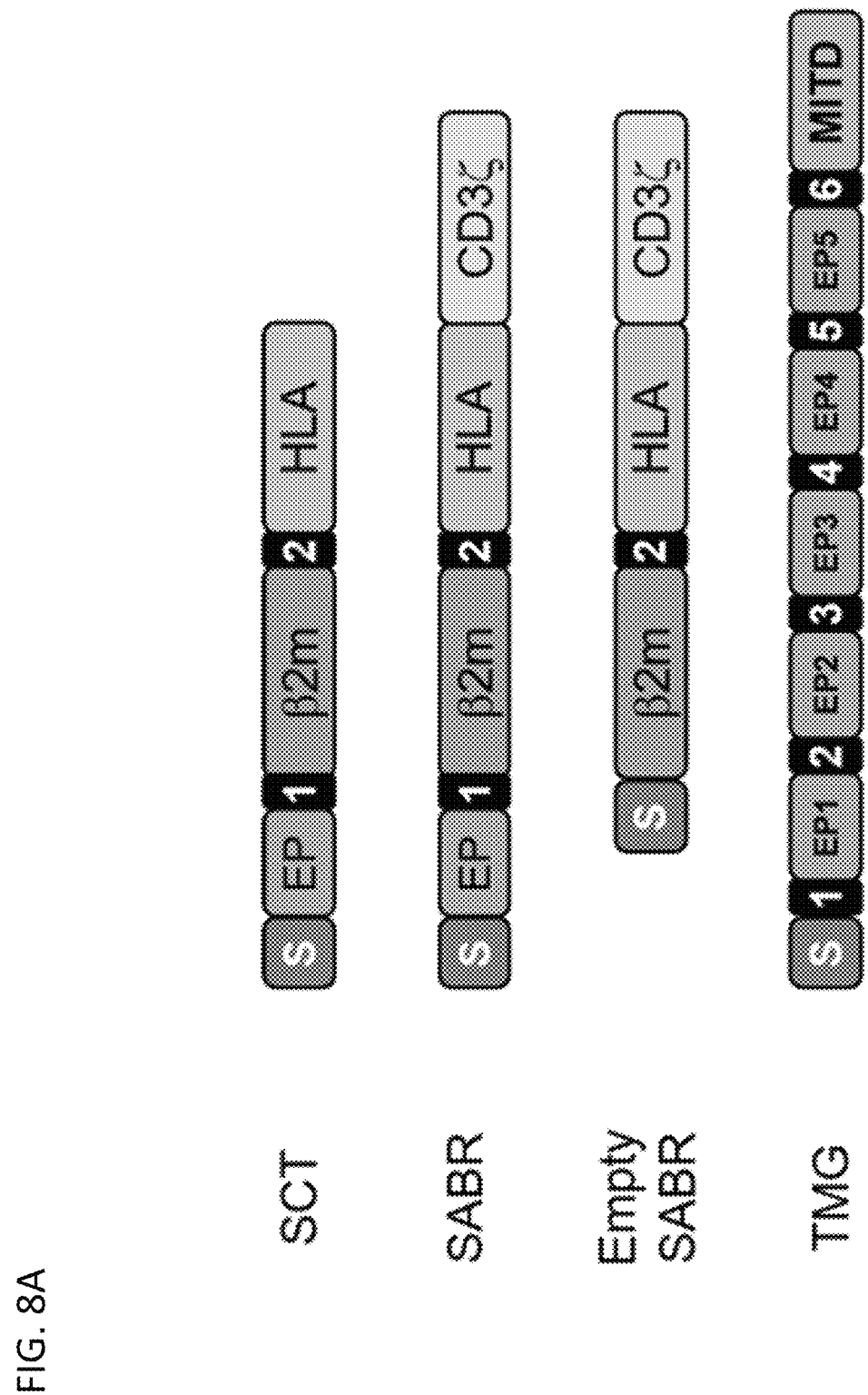
FIG. 8A illustrates a schematic showing SCT, SABRs, empty SABRs, and tandem minigenes (TMGs) according to various embodiments.
Figure 8B:
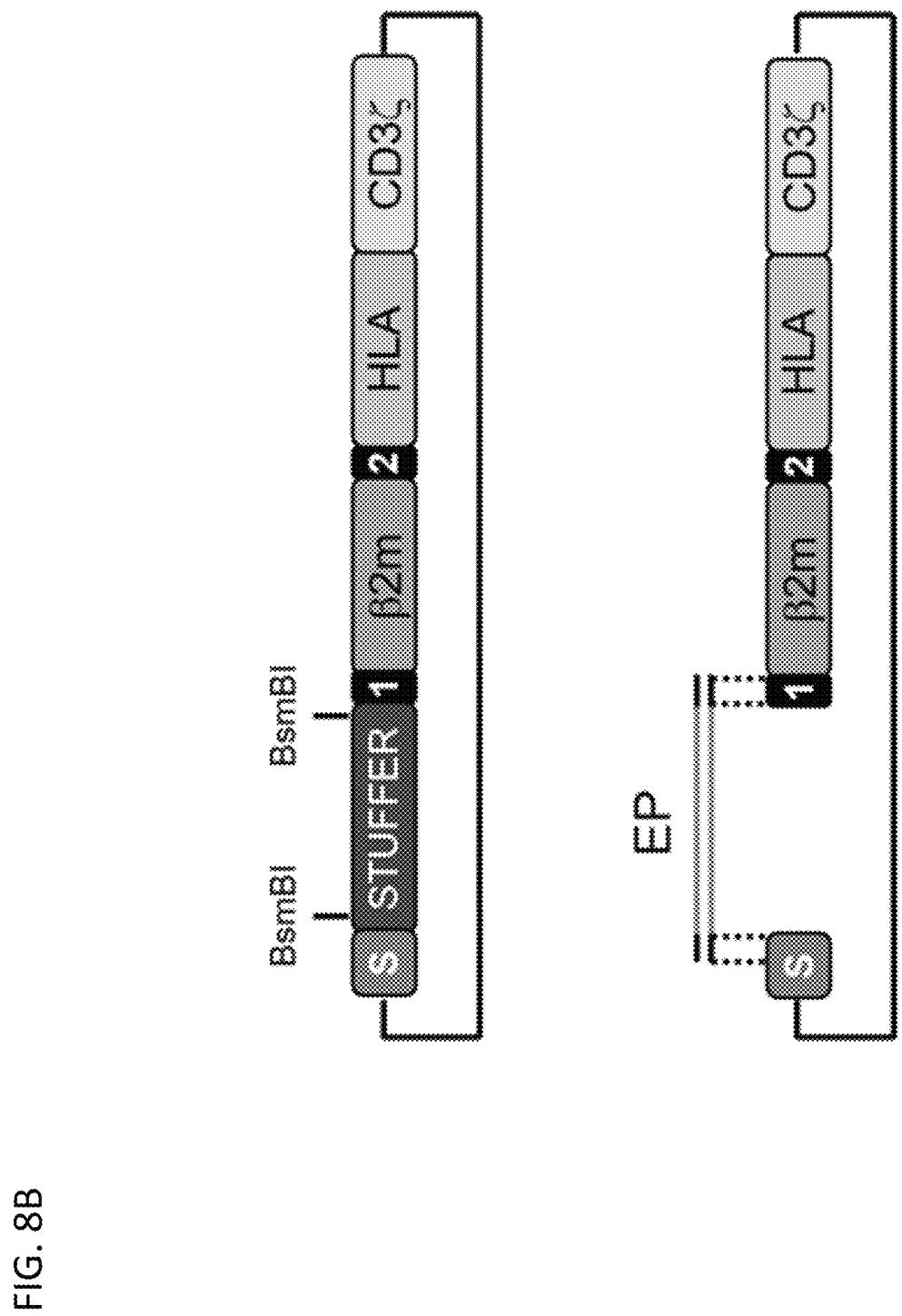
FIG. 8B illustrates SABR vector constructs with a stuffer fragment showing BsmBI sites, and a cloning strategy using double stranded oligonucleotides with encoding an epitope flanked by overlaps according to various embodiments.
Figure 8C:
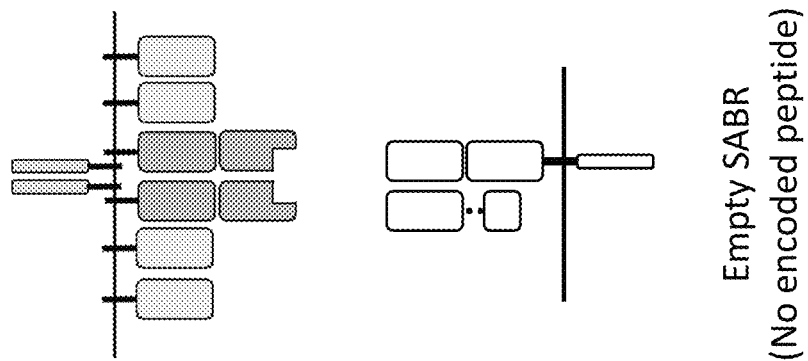
FIG. 8C illustrates an empty SABR construct according to various embodiments.
Figure 8D:
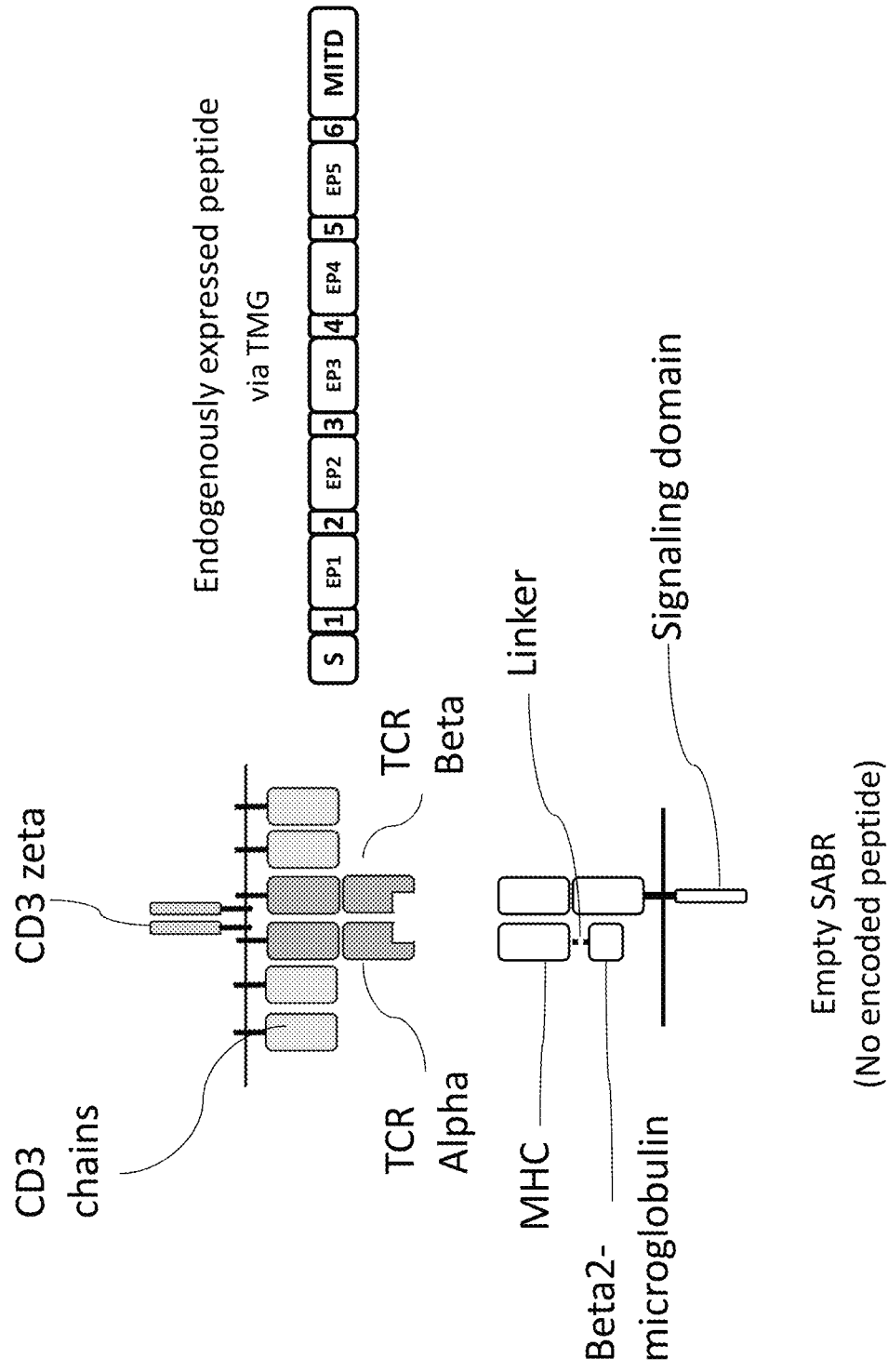
FIG. 8D illustrates an empty SABR (i.e. no encoded peptide) and endogenously expressed peptide according to various embodiments herein.

The endogenous MHC complexes described above present epitopes from newly translated proteins or endocytosed proteins via cross-presentation. To test if SABRs can also utilize these pathways for antigen presentation, an 'empty' version of SABRs was constructed that linked β2-microglobulin with A2 or B27 but did not genetically encode for an epitope. FIG. 8A illustrates a schematic showing SCT, SABRs, empty SABRs, and tandem minigenes (TMGs) according to various embodiments, with epitope (EP), signal sequence (S), and MHC class I trafficking signal (MIHC). Within FIG. 8A, numbers 1-6 indicate Gly-Ser linkers. FIG. 8B illustrates SABR vector constructs with a stuffer fragment showing BsmBI sites, and a cloning strategy using double stranded oligonucleotides with encoding the epitope flanked by overlaps according to various embodiments. FIG. 8C illustrates an empty SABR construct according to various embodiments. FIG. 8D illustrates an empty SABR (i.e. no encoded peptide) and endogenously expressed peptide according to various embodiments herein.

SABR-APCs were incubated with soluble peptides to test presentation and recognition of those peptides. FIG. 8E illustrates a schematic of empty SABRs pulsed with exogenous peptide. NFAT-GFP-Jurkat cells expressing the empty SABRs were incubated with soluble MART1 or KK10 peptides and co-cultured them with Jurkat cells expressing F5 or EC27 TCRs.

FIG. 8F illustrates a graph showing GFP expression by NFAT-GFP-Jurkats transduced with empty SABRs pulsed with soluble MART1 or KK10 peptides and co-cultured with Jurkat cells transduced with F5 or EC27 TCRs. The Y-axis shows % GFP+ cells in co-culture assays performed with 10,000 effector and 10,000 target cells at 8 hours after co-culture. The bars indicate mean±sd, n=3. Both A2 and B27 empty SABRs induced a signal only in presence of the soluble peptide corresponding to the TCRs, and not in presence of mismatched peptide or in absence of soluble peptide. Moreover, the signal induced by correct peptide-TCR combinations was comparable to the signal induced by the corresponding SABRs presenting covalently linked epitopes.

Figure 8H:
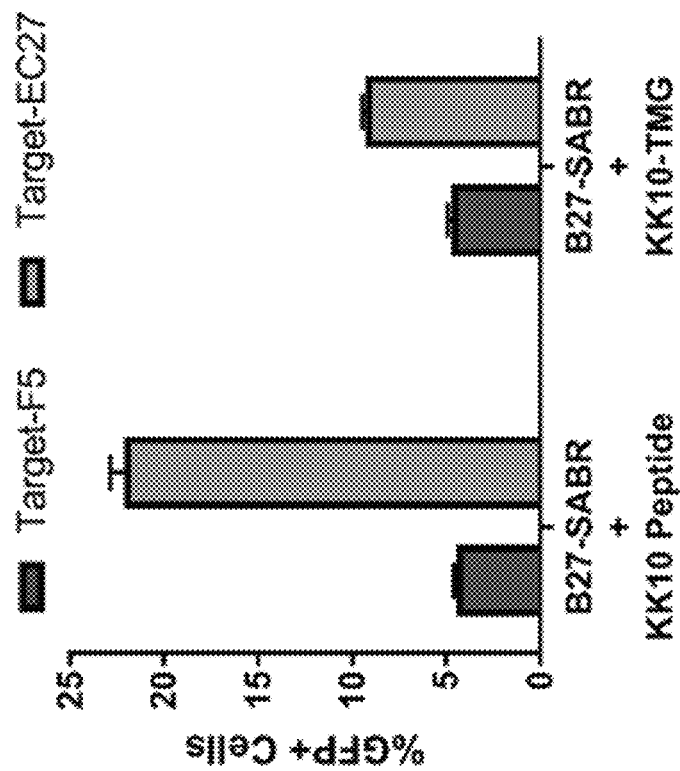
FIG. 8H illustrates a graph of GFP expression by NFAT-GFP-Jurkats co-transduced with empty B27-SABRs KK10-TMG or transduced with empty B27-SABRs and pulsed with KK10 peptide, and co-cultured with Jurkat cells transduced with F5 or EC27 TCRs.
Figure 8G:
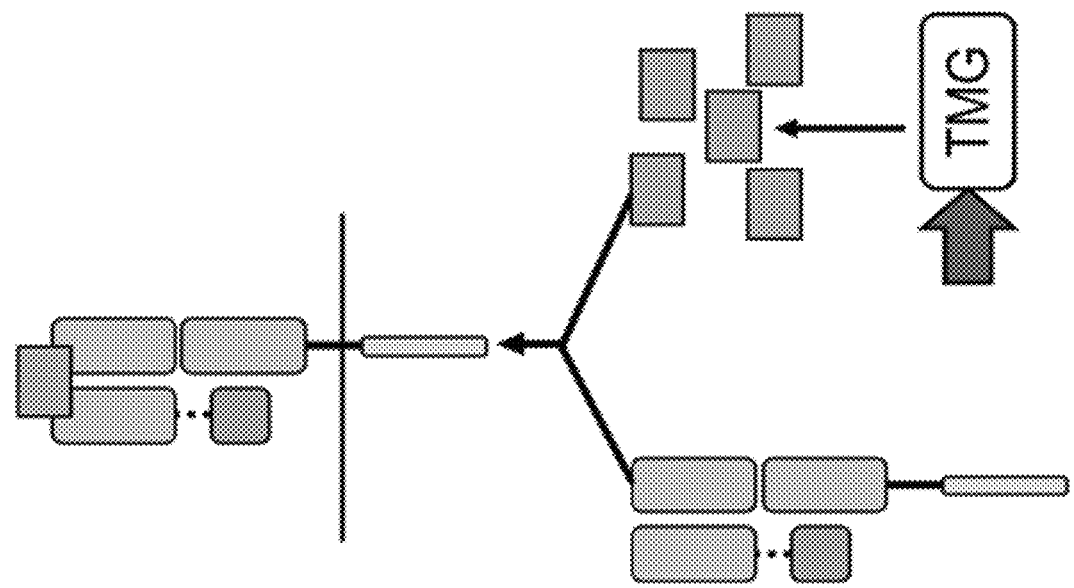
FIG. 8G illustrates a schematic of empty SABRs presenting newly translated epitopes with a TMG.

Endogenously processed peptide epitopes were tested to determine if they could be presented on 'empty' SABRs. Therefore, pentameric TMGs were constructed to express the KK10 epitope along with four irrelevant CMV-derived epitopes. FIG. 8G illustrates a schematic of empty SABRs presenting the newly translated epitopes, with a TMG.

NFAT-GFP-Jurkat cells were co-transduced with the empty B27-SABR and the KK10 TMG. Following co-incubation with EC27- or F5-expressing Jurkat cells, the 'empty' SABRs were able to present the endogenously expressed epitopes and induce specific signaling, as illustrated in FIG. 8H. FIG. 8H illustrates a graph of GFP expression by NFAT-GFP-Jurkats co-transduced with empty B27-SABRs KK10-TMG or transduced with empty B27-SABR and pulsed with KK10 peptide, and co-cultured with Jurkat cells transduced with F5 or EC27 TCRs. The Y-axis shows % GFP+ cells in co-culture assays performed with 50,000 effector and 50,000 target cells at 8 hours after co-culture. Within FIG. 8H, bars indicate mean±sd, n=3. However, the overall signal was lower than the corresponding empty SABRs were pulsed with soluble peptide. These results show that SABRs can present non-covalently linked epitopes generated through endogenous antigen processing and presentation pathways.

Figures 8I, 8J, 8K:
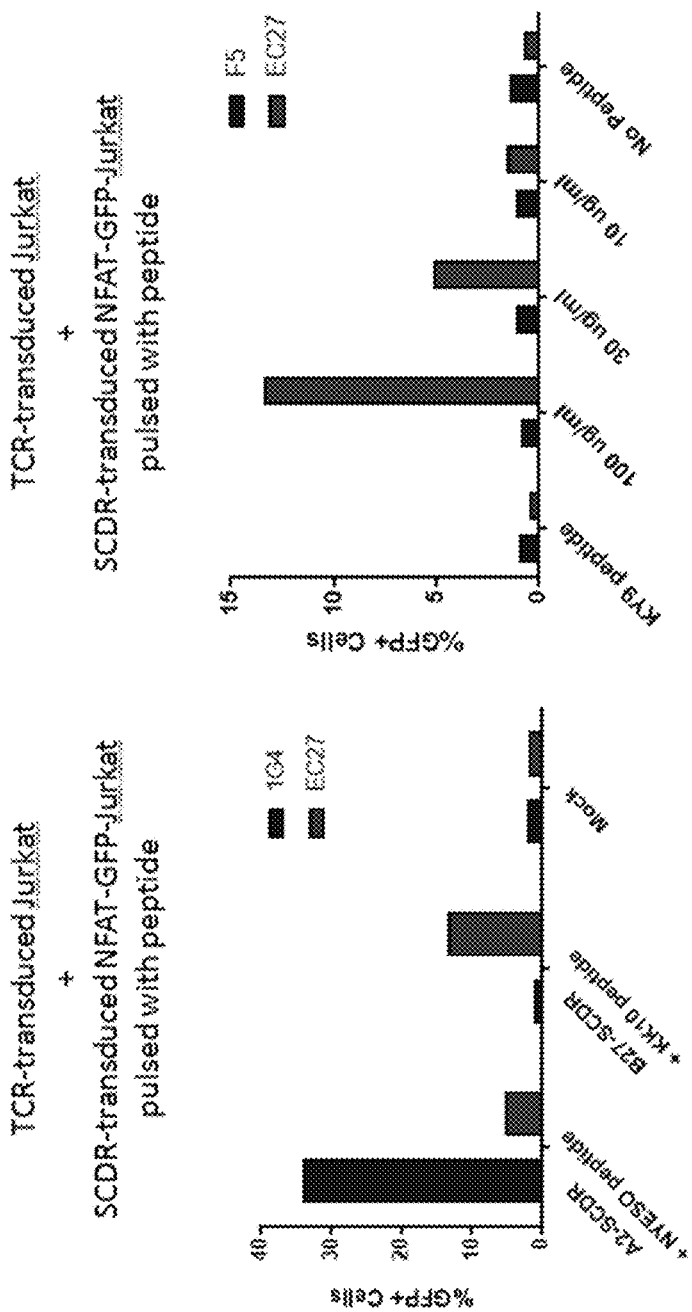
FIG. 8I illustrates an SCDR construct with a CD3z signal transduction domain according to various embodiments herein.
FIG. 8J illustrates a bar graph showing % GFP+ frequency for various TCR-peptide variations.
FIG. 8K illustrates a bar graph showing % GFP+ frequency for various TCR-peptide composition and concentration variations.

SABRs can present non-covalently linked epitopes generated through endogenous antigen processing and presentation pathways. FIG. 8I illustrates an SCDR construct with a CD3z signal transduction domain according to various embodiments herein. TCR-transduced Jurkat cells were incubated with the SCTR constructs and pulsed with peptide antigen. FIG. 8J illustrates a bar graph showing % GFP+ frequency for various TCR-peptide variations. FIG. 8K illustrates a bar graph showing % GFP+ frequency for various TCR-peptide composition and concentration variations. The results show that, like T cell signaling, SABR signaling is titratable with the amount of peptide presented.

Figures 8L, 8M:
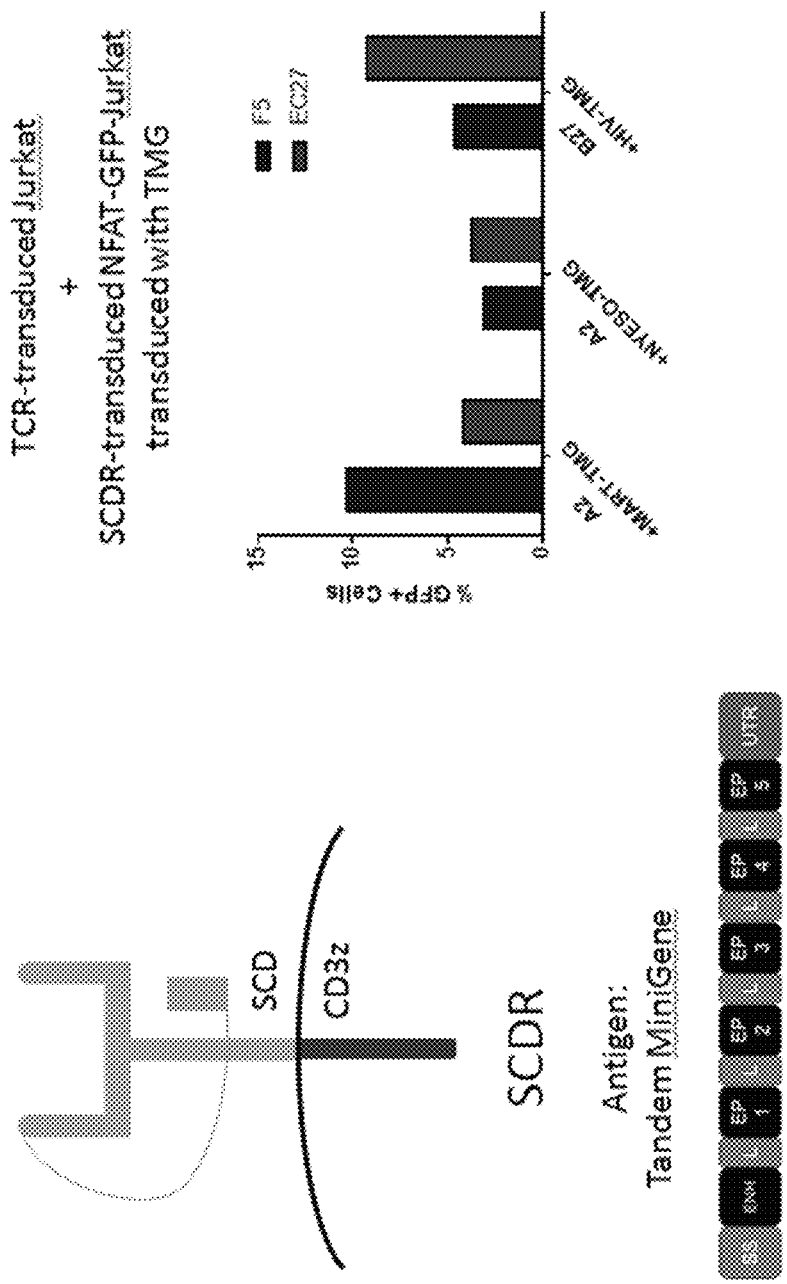
FIG. 8L illustrates a schematic showing an SCDR construct with a tandem minigene (TMG) antigen according to various embodiments herein.
FIG. 8M illustrates a bar graph showing % GFP+ frequency for various TCR-peptide variations.

FIG. 8L illustrates a schematic showing an SCDR construct with a tandem minigene (TMG) antigen according to various embodiments herein. TCR-transduced Jurkat cells were incubated with the SCTR-transduced NFAT-GFP-Jurkat cells transduced with TMG. FIG. 8M illustrates a bar graph showing % GFP+ frequency for various TCR-TMG variations. The results show that SABRs will present endogenous peptide (fragmented protein sequences derived from proteins in the cell) when not directly linked to an antigen.

Example 3

SABRs Initiating Bona Fide TCR Signal

To use SABRs as a therapeutic target, a SABR that binds to a pathogenic T cell in a patient can be identified. The SABR can be cloned into appropriate vectors for immunotherapy, such as lentiviral or retroviral vectors. The patient's own blood can be subjected to leukapheresis followed by isolation of T cells. The T cells can be activated and expanded using commercial methods such as using the OKT3 antibody. The expanded T cells can be transduced with the vector containing the SABR. The transduced cells can be reinfused into the patient as a therapeutic. The expanded T cells expressing the appropriate SABRs should target the pathogenic T cells in the patient and lead to elimination of the pathogenic T cells, leading to disease amelioration.

This can be done for type 1 diabetes, where a pathogenic T cell can target an insulin-derived epitope in the context of HLA-A2.1 (A2.1-Insulin). In this case, a SABR comprising of HLA-A2.1, presenting the Insulin epitope, and a signaling domain can be cloned into a lentiviral vector. The patient's own T cells can be expanded and transduced with the A2.1-Insulin-SABR expressing vector. The cells can be reinfused into the patient, where they can eliminate the pathogenic T cells that target A2.1-Insulin.

Figure 9A:
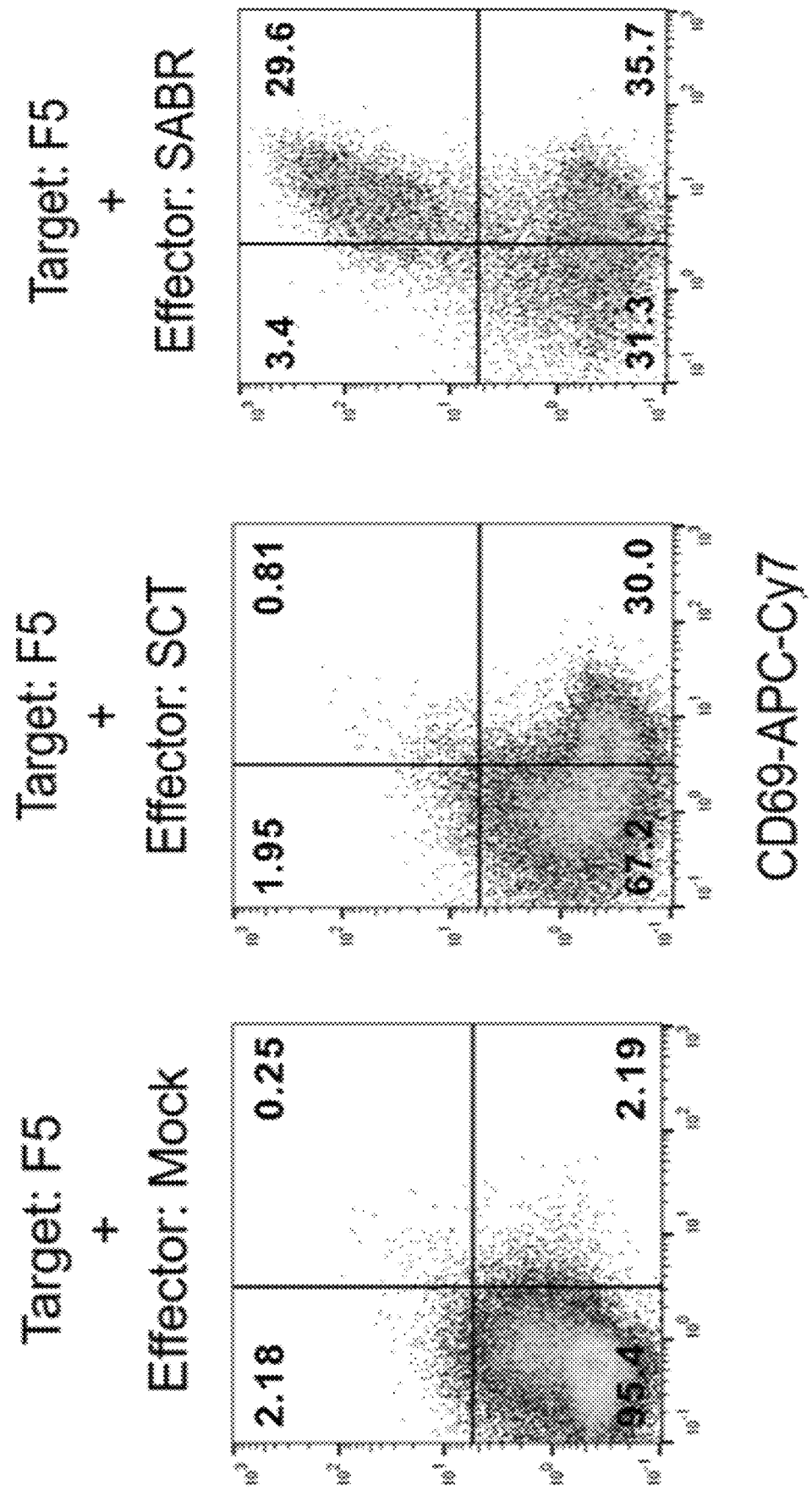
FIG. 9A illustrates representative flow cytometry plots of induction of CD69 by SABRs.

SABRs use a CD3ζ-CD28 domain for intracellular signaling, similar to chimeric antigen receptors (CARs) and TCRs. Therefore, intracellular signaling ability of SABRs is comparable to TCRs was tested. SABRs ability to induce early activation markers in NFAT-GFP-Jurkat cells was tested. NFAT-GFP-Jurkat cells transduced with the A2-MART1-SABR expressed CD69, an early T cell activation marker, upon co-culture with Jurkat cells transduced with F5 TCR. Co-expression of reporter-driven GFP and endogenous CD69 in cells expressing A2-MART1-SABR, but not the A2-MART1 single chain trimer implies that SABR signaling activates endogenous gene expression, as shown in FIG. 9A. FIG. 9A illustrates representative flow cytometry plots from one experiment of induction of CD69 by SABRs. GFP and CD69 expression in co-culture assays using 10,000 NFAT-GFP-Jurkat cells transduced with the indicated SABRs and 10,000 Jurkat cells transduced with F5 TCR is shown. The frequencies of cells in each gate are indicated as percentage.

Figure 9B:
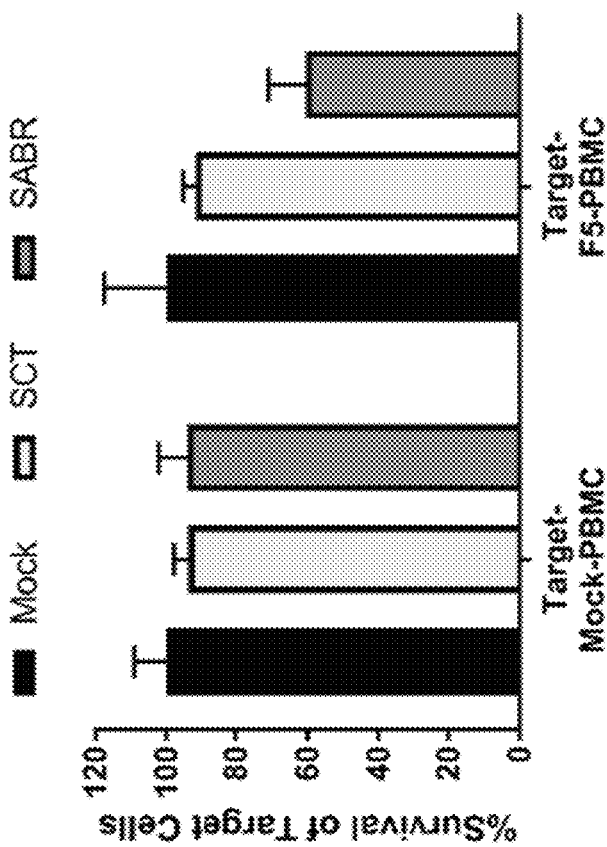
FIG. 9B illustrates a graph of cytotoxicity induced by SABR-expressing primary T cells against Jurkat cells.
Figure 9C:
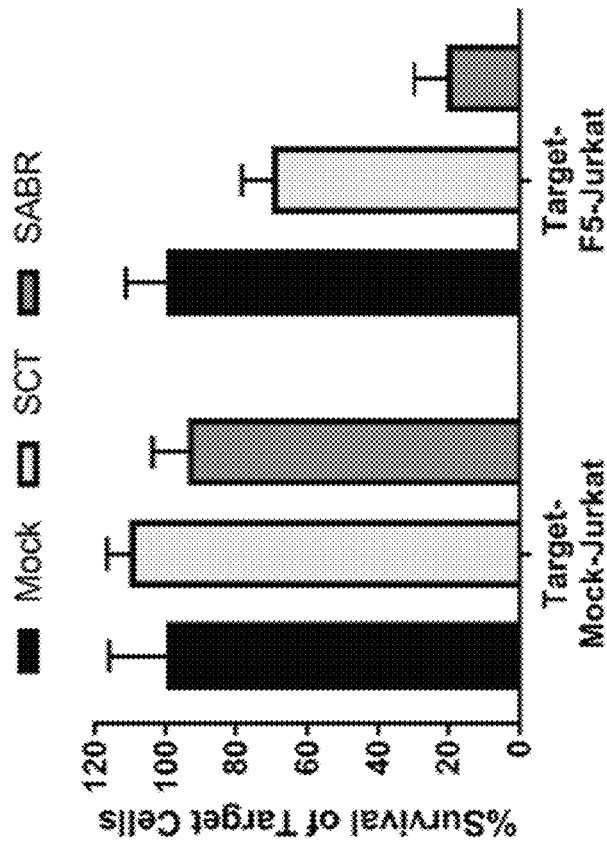
FIG. 9C illustrates a bar graph of cytotoxicity induced by SABR-expressing primary T cells against autologous target cells.

In some embodiments, if SABRs induce a bona fide TCR signal, they can confer cytotoxic capabilities to primary T cells. Activated primary T cells were transduced with A2-MART1-SABR and incubated with CFSE-labeled target cells expressing F5 TCR. Transduced primary T cells lysed Jurkat cells or primary T cells expressing the F5 TCR specifically, as shown in FIG. 9B and FIG. 9C. FIG. 9B illustrates a graph of cytotoxicity induced by SABR-expressing primary T cells against Jurkat cells. The Y-axis shows % survival of CFSE-labeled target cells at 24 hours after co-culture. Cytotoxicity assays were performed with 200,000 SABR-transduced cells and 50,000 TCR-transduced cells. With FIG. 9B, bars indicate mean±sd, n=8. FIG. 9C illustrates a bar graph of cytotoxicity induced by SABR-expressing primary T cells against autologous target cells. The Y-axis shows % survival of target cells at 24 hours after co-culture. Cytotoxicity assays were performed with 200,000 SABR-transduced cells and 50,000 TCR-transduced cells. Within FIG. 9C, bars indicate mean±sd, n=8.

Figure 9E:
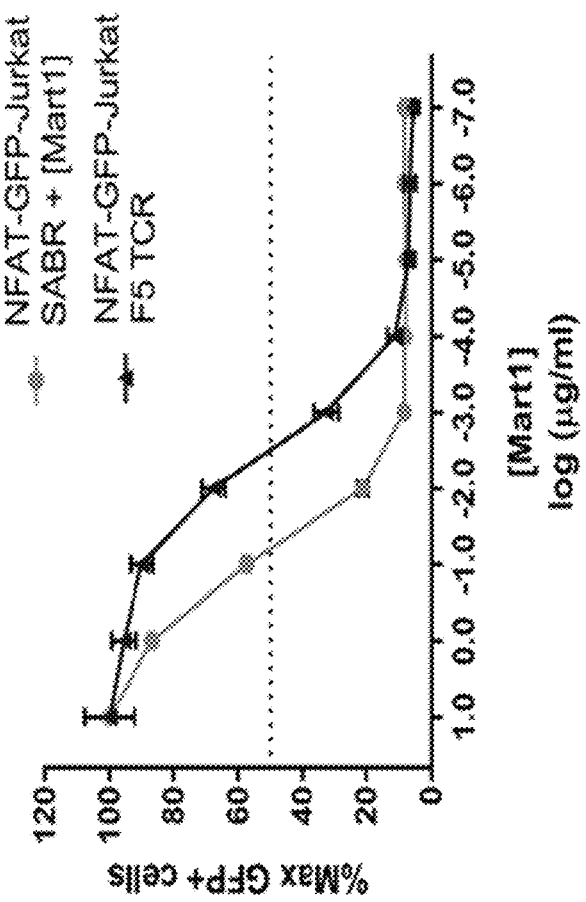
FIG. 9E illustrates a plot of antigen sensitivity of SABR and TCR signaling.
Figure 9D:
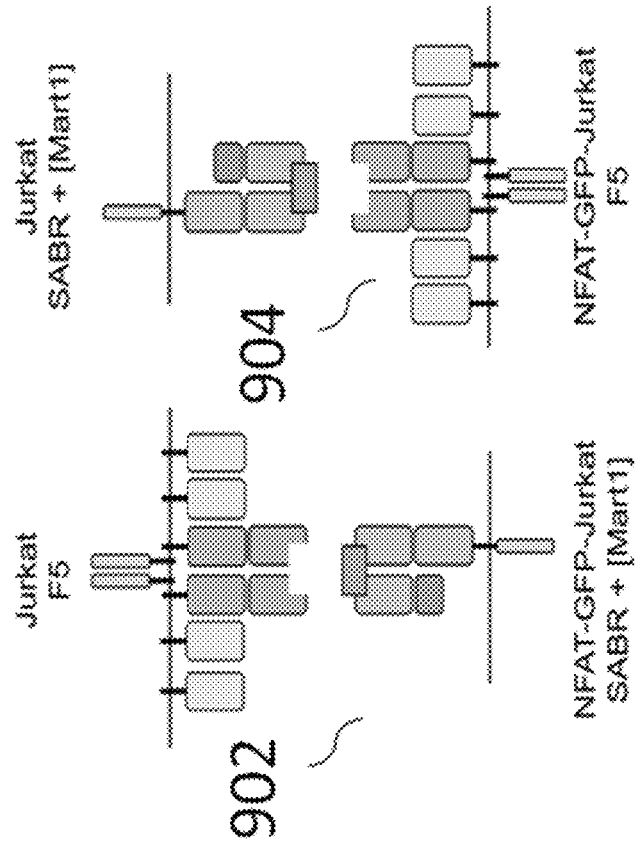
FIG. 9D illustrates a schematic of an assay to measure antigen sensitivity of A2-SABR and of F5-TCR.

The antigen sensitivity of SABRs and TCRs was compared. To that end, NFAT-GFP-Jurkat cells were transduced with either empty A2-SABR or F5 TCR and used as effectors. As targets, Jurkat cells transduced with A2-SABR or F5 TCR were used, as shown in FIG. 9D. FIG. 9D illustrates a schematic of the assay to measure antigen sensitivity of A2-SABR 902 and of F5-TCR 904.

Effectors were co-cultured with their cognate targets in presence of a range of concentrations of the MART1 peptide, and GFP expression was measured. Antigen sensitivity was determined as the concentration of the peptide required for half-maximal signaling. The antigen sensitivity of SABRs was 30-fold lower as compared to TCRs, as shown in in FIG. 9E. FIG. 9E illustrates a plot of antigen sensitivity of SABR and TCR signaling. The Y-axis shows % maximum of % GFP+ cells at 8 hours in co-culture assays using 50,000 SABR- or TCR-transduced cells pulsed with the MART1 peptide. The X-axis shows the concentration of the MART1 peptide used to pulse the cells. Within, FIG. 9E, dots indicate mean±sd, n=3. The dotted horizontal line indicates half-maximal signal.

Taken together, these results show that SABRs signal similar to TCRs, albeit, in some examples, with lower antigen sensitivity.

Example 3 above is also an example of SABRs as a therapeutic. For example, in a case where the F5 TCR can be substituted with a pathogenic TCR, such as a TCR recognizing type 1 diabetes antigens. In the therapeutic scenario, a similar experiment to show efficacy can be done where the SABR is presenting the antigen recognized by the pathogenic TCR. Primary T cells expressing the said SABR can then be used to induce cytotoxicity against the pathogenic TCR, and subsequently eliminate them for therapeutic benefit Example 4

Antigen Discovery using SABR Libraries

Figure 10A:
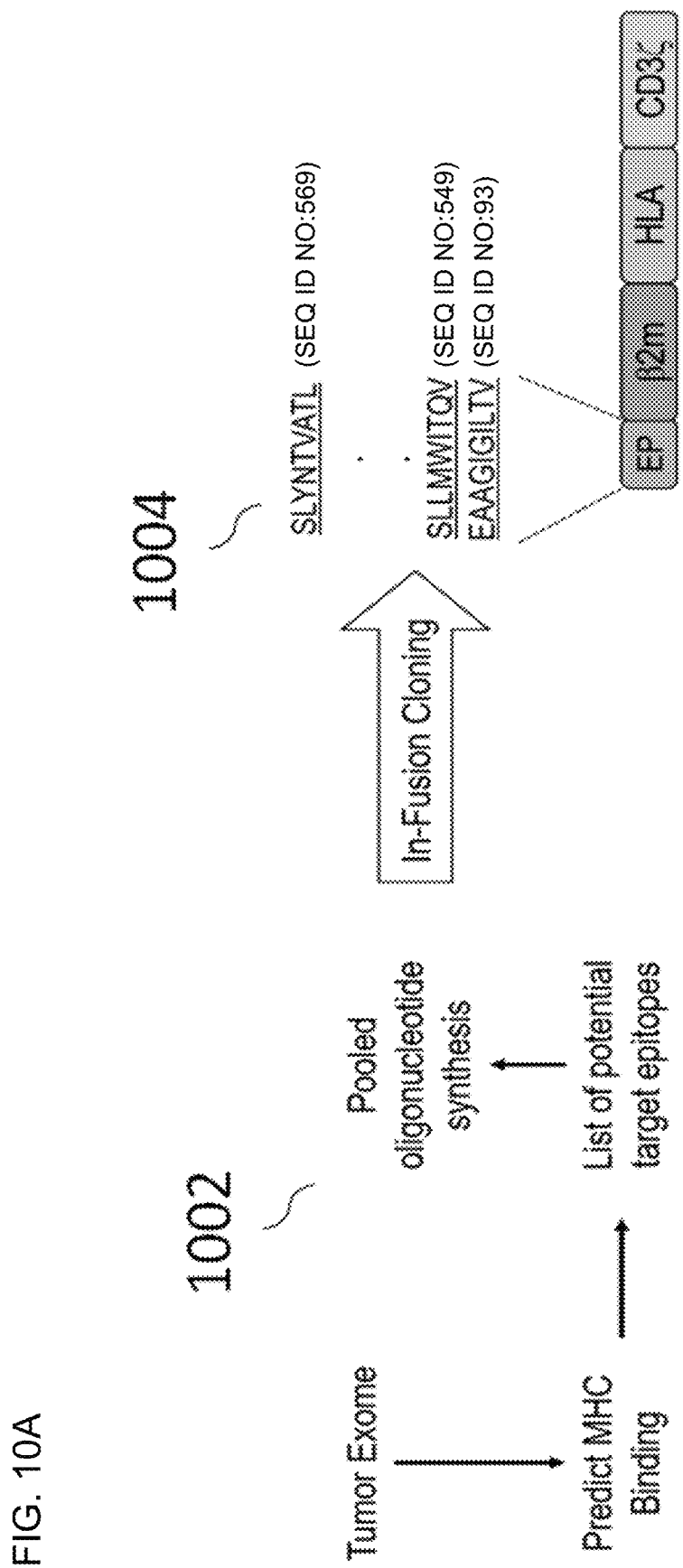
FIG. 10A illustrates a schematic showing a pipeline to construct custom SABR libraries according to various embodiments.

In some embodiments, by virtue of genetically linking the peptide epitope with MHC, SABRs can be used to present a defined antigen and to report its successful recognition by a TCR. Therefore, SABR libraries ability to present a large number of epitopes to be used to screen successful TCR-pMHC interactions was tested. A strategy to construct and use SABR libraries for T cell antigen discovery of 'orphan' antitumor TCRs with unknown antigens was created. First, a list of target epitopes was generated from an existing database or from tumor exome data followed by prediction of MHC binding. Pooled oligonucleotide libraries encoding for target epitopes were synthesized and cloned into the SABR plasmid, according to FIG. 10A. FIG. 10A illustrates a schematic showing the pipeline to construct custom SABR libraries according to various embodiments. The left panel 1002 shows the procedure to obtain and synthesize a list of epitopes. The right 1004 shows the schematic of the SABR library.

Figure 10B:
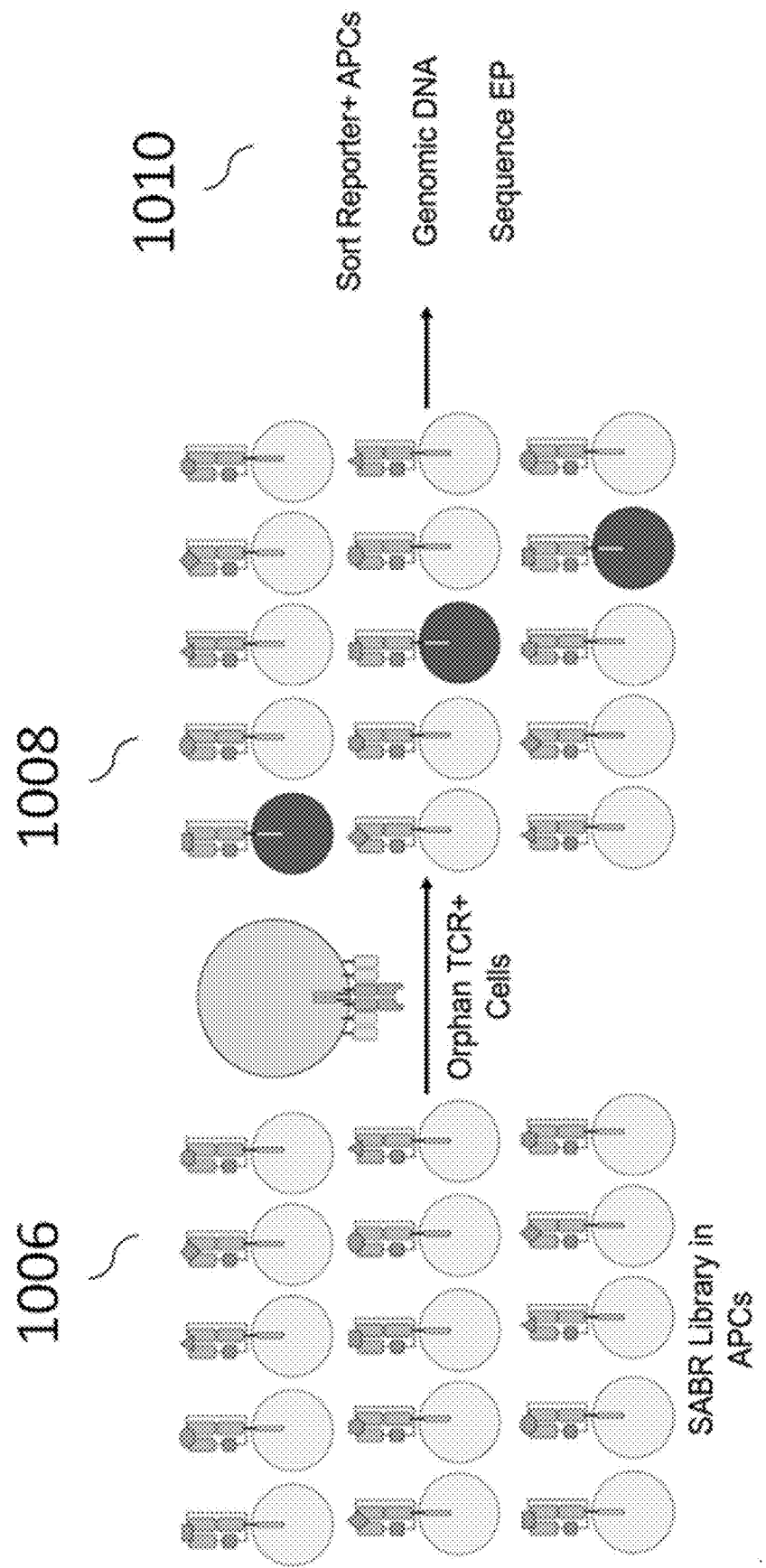
FIG. 10B illustrates a schematic showing a co-culture experiment to select cells from a SABR library that are recognized by an orphan TCR according to various embodiments.

The SABR libraries were packaged into lentiviral vectors and used to transduce NFAT-GFP-Jurkat cells. NFAT-GFP-Jurkat cells expressing the SABR library were co-cultured with Jurkat cells expressing an 'orphan' TCR. GFP+CD69+ NFAT-GFP-Jurkat cells were sorted using fluorescence activated cell sorting (FACS), followed by genomic DNA extraction. The epitope portion of the SABRs was amplified and subjected to high throughput sequencing, as shown in FIG. 10B. FIG. 10B illustrates a schematic showing the co-culture experiment to select cells from the SABR library that are recognized by an orphan TCR according to various embodiments. The left panel 1006 shows a SABR library presenting numerous unique epitopes. The middle panel 1008 shows cells APCs showing reporter expression induced by SABRs presenting the cognate epitope for the orphan TCR. The right panel 1010 shows processing steps of the selected cells.

Figure 10C:
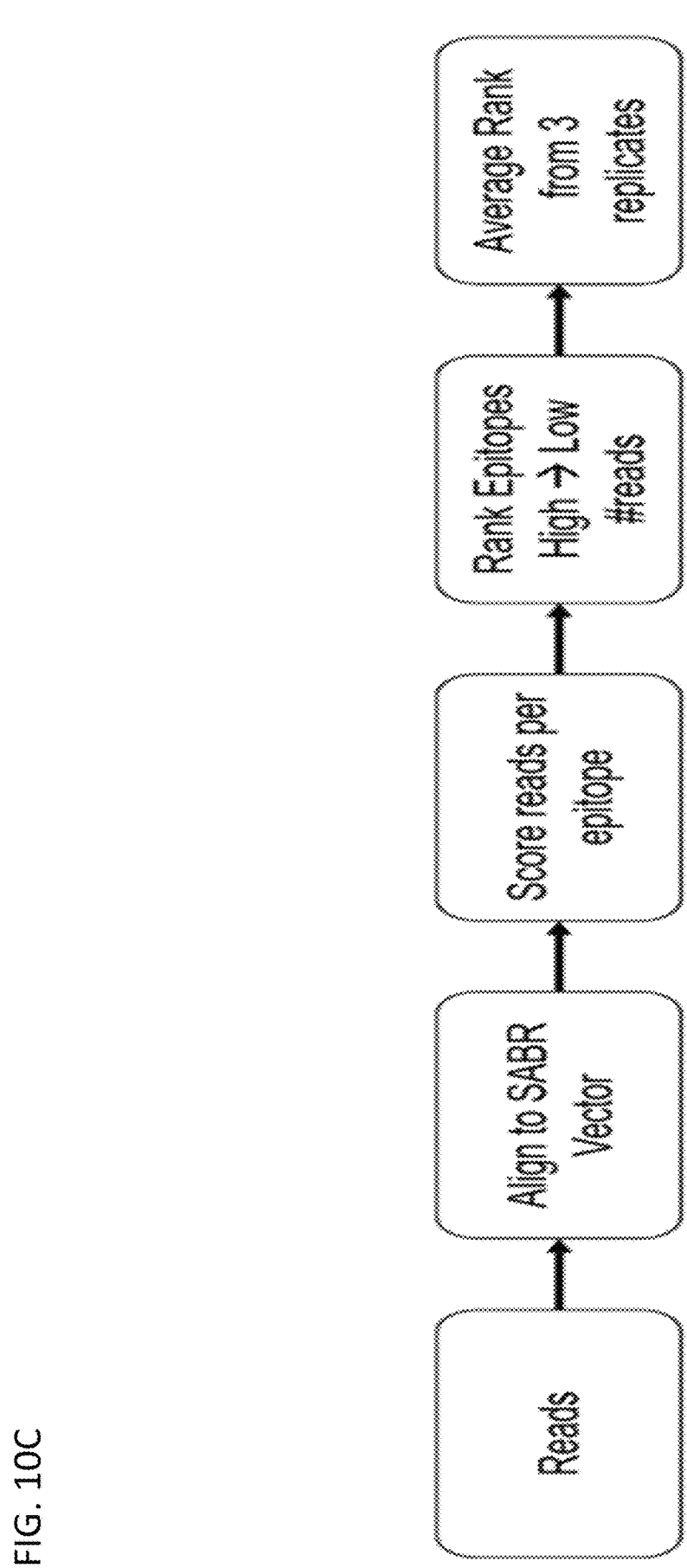
FIG. 10C illustrates a flowchart showing a computational analysis pipeline according to various embodiments.

The sequencing reads were aligned with the SABR vector backbone using Burrows-Wheeler alignment. Aligned reads were translated to reveal the epitope. The number of reads corresponding to each epitope was counted and reported in a list. A minimum of three replicates of the co-incubation assay were performed. For each replicate, a numerical rank was given to each epitope based on descending order of the number of reads. The rank from three replicates for each assay was averaged and reported as 'Average Rank', according to the flowchart in FIG. 10C. FIG. 10C illustrates a flowchart showing the computational analysis pipeline.

The top ranked epitopes were putative antigens for that TCR and are subsequently validated by constructing individual SABRs presenting each of the epitopes and measuring GFP expression in co-culture assays.

Figure 11A:
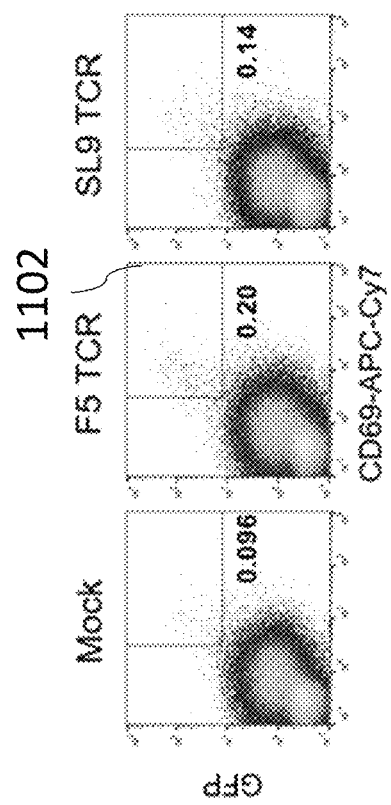
FIG. 11A illustrates representative flow cytometry plots.

To demonstrate proof-of-concept of the approach detailed in FIGS. 10A-10C, the SABR libraries ability to identify the cognate antigens of known public TCRs in an unbiased manner was tested. A SABR library encoding 12,055 epitopes presented on HLA-A*0201 (A2-SABR-library) consisting of all known HLA-A*0201-restricted epitopes from the Immune Epitope Database (IEDB) was constructed. The ability of the A2-SABR-library to identify the cognate antigen for two TCRs with known specificities (F5, which recognizes EAAGIGILTV, and SL9, which recognizes SLYNTVATL) was tested. NFAT-GFP-Jurkat cells were transduced with the A2-SABR-library and incubated with Jurkat cells expressing F5 or SL9 TCRs. After 10 hours of co-culture, GFP+CD69+ cells were sorted by FACS, the genomic DNA was extracted, the epitopes were sequenced, and average ranks for each epitope as described were calculated in FIGS. 10A-10C. FIG. 11A illustrates representative flow cytometry plots from one replicate. The A2-SABR library cells were sorted based on reporter gene expression. Co-culture assays using 9 million library cells with 9 million TCR-transduced Jurkat cells were set up. At 10 hours post co-culture, the cells were stained for CD69 and sorted using FACS. The rectangle 1102 in the top right corner of each flow plot shows the gate used for the sort. The frequency of cells in the sort gate is indicated as a percentage.

Figure 11B:
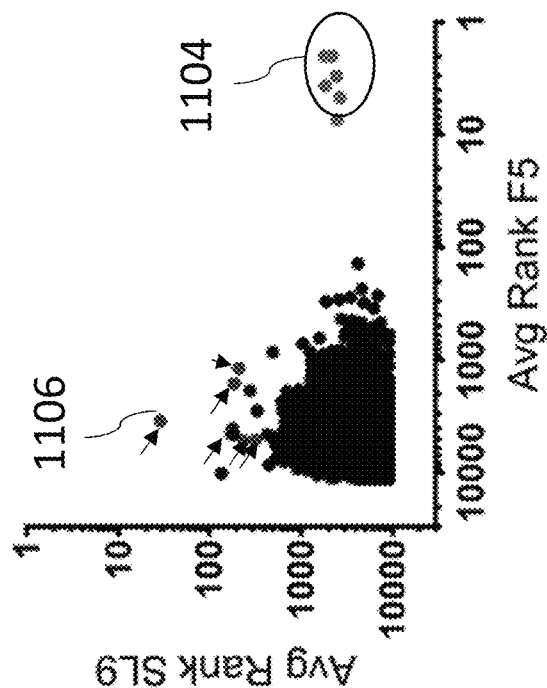
FIG. 11B illustrates a plot of average ranks from F5 and SL9 sorts.

The average ranks of each of the epitopes from the SL9 sort against those from F5 sort were plotted. FIG. 11B illustrates a plot of average ranks from the F5 and SL9 sorts. Within FIG. 11B, each dot represents the average rank for a unique epitope as calculated using the procedure described in FIGS. 10A-10C. The Y-axis shows the average rank in the SL9 sort, and the X-axis shows the average rank in the F5 sort. Dots 1104 indicate SEQ ID NO: 12174 analogs and dots 1106 indicate SEQ ID NO: 12194 analogs.

Six epitopes formed a distinct cluster by their rank in the F5 sort. In the SL9 sort, the top ranks were outliers, but did not form a separate cluster. FIG. 11C illustrates a plot of the average ranks for the top 24 hits from the F5 sort. The epitopes with asterisks indicate SEQ ID NO: 12174 analogs. The top six epitopes in the F5 sort were analogs of SEQ ID NO: 12174, indicating successful identification of its antigen, as shown in FIG. 11C.

Figure 11D:
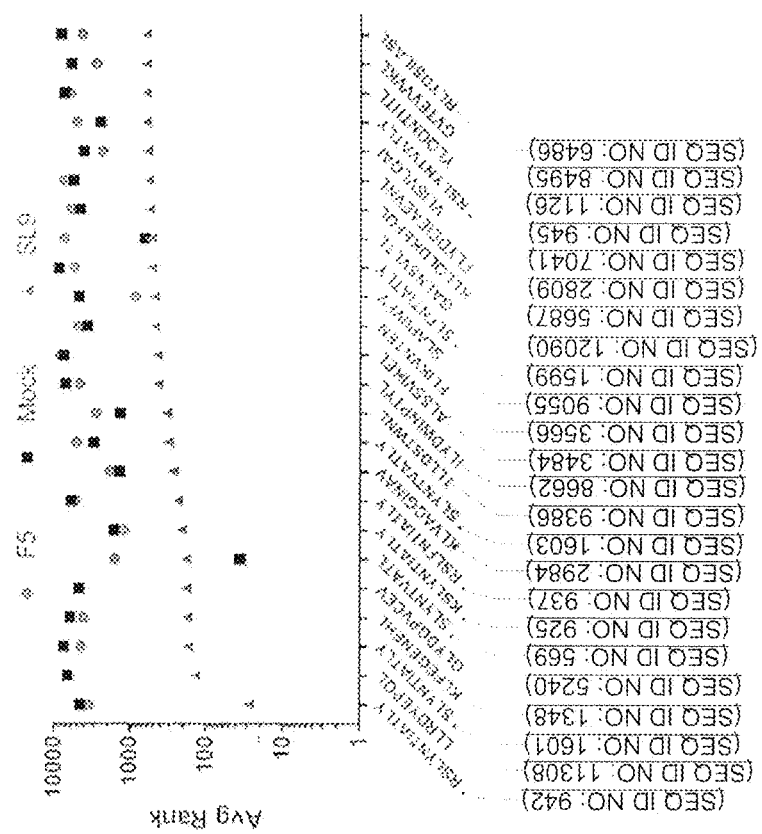
FIG. 11D illustrates a plot of average ranks for hits from an SL9 sort.
Figure 11C:
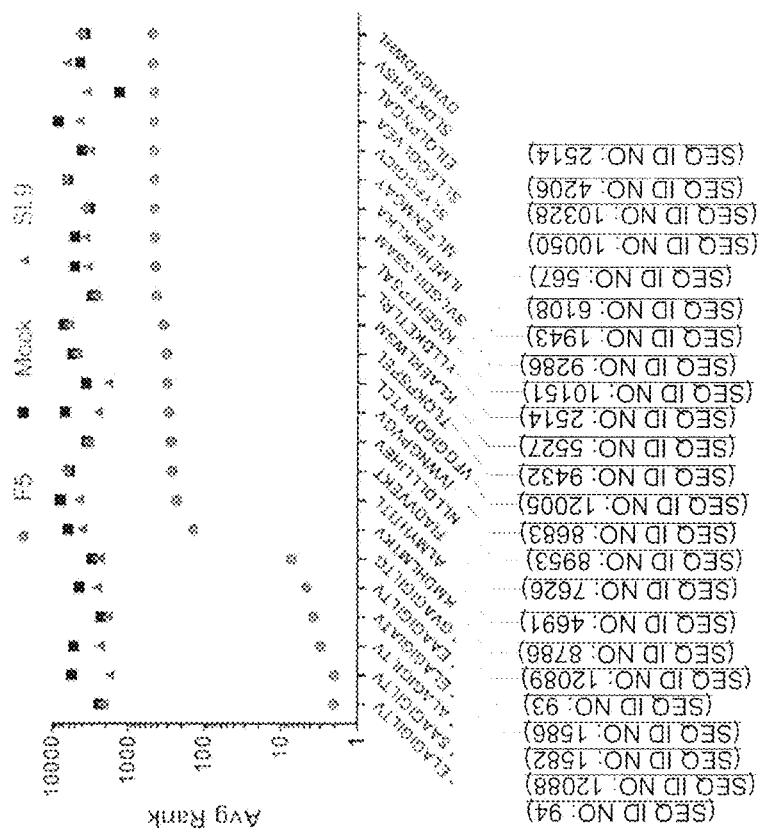
FIG. 11C illustrates a plot of average ranks for hits from an F5 sort.
Figure 11F:
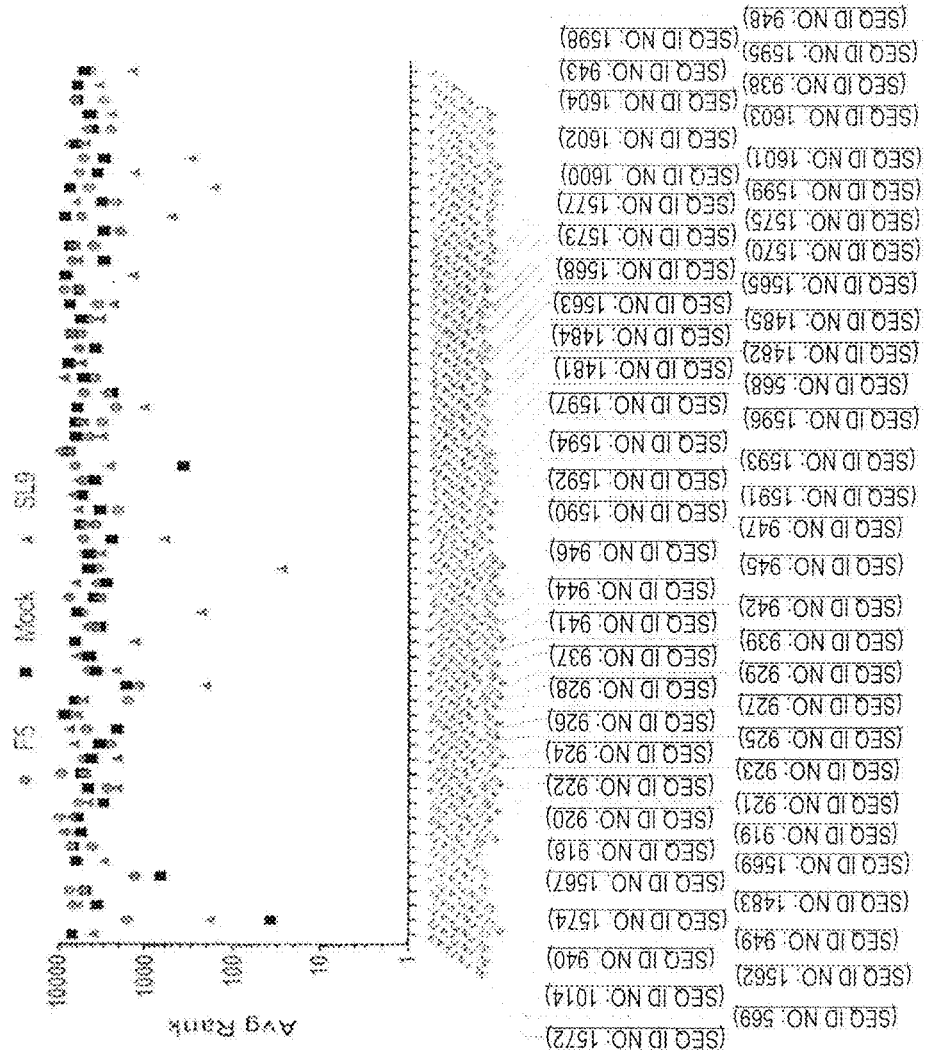
FIG. 11F illustrates a plot of average ranks for SLYNT-VATL (SEQ ID NO: 12194) analogs in an A2-SABR library.
Figure 11E:
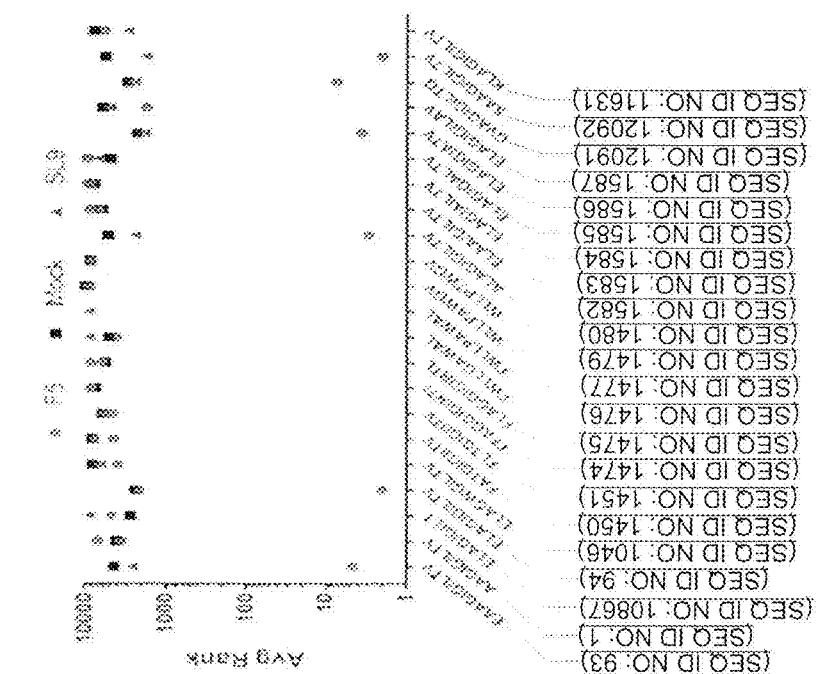
FIG. 11E illustrates a plot of average ranks for EAA-GIGILTV (SEQ ID NO: 12174) analogs in an A2-SABR library of Example 4.

FIG. 11D illustrates a plot of the average ranks for the top 24 hits from the SL9 sort. The epitopes with asterisks indicate SLYNTVATL analogs. Six out of the top ten epitopes from the SL9 sort were analogs of SLYNTAVATL, as shown in FIG. 11D. FIG. 11E illustrates a plot of the average ranks for all the EAAGIGILTV analogs in the A2-SABR library. FIG. 11F illustrates a plot of the average ranks for all the SLYNTVATL analogs in the A2-SABR library. Epitopes enriched for their corresponding TCRs were not enriched in mismatched TCRs, as shown in FIGS. 11E and 11F.

The noise observed in the SL9 sort was presumably due to the higher number of analogs of the SLYNTVATL peptide. The A2-SABR library contains 22 analogs EAA-GIGILTV and 60 analogs of SLYNTVATL. A higher number of recognized analogs would lower the average rank for each of the epitopes because of competition among the epitopes.

The ranks of all the analogs of EAAGIGILTV and SLYNTVATL in the sorts were compared. Six out of twenty-two EAAGIGILTV analogs were identified in the F5 sort, as shown in FIG. 11E, whereas nine out of sixty SLYNTVATL analogs were identified in the SL9 sort, as shown in FIG. 11F. The lack of identification of all the analogs is presumably due to reduced cross-reactivity of the F5 or SL9 TCRs towards them. Indeed, analogs SLYNTIATL (V6I) and SLFNTVATL (Y3F) are documented escape mutations in the SLYNTVATL epitope. Nevertheless, these experiments showed that a SABR library approach could identify the cognate antigen of a TCR by screening thousands of epitopes.

Example 5

Personalized Neoantigen Discovery Using SABRs

SABRs can be implemented to identify candidate T cell receptors (TCRs) for immunotherapy of a tumor. Genomic DNA or RNA from a tumor biopsy would first be sequenced and compared to non-tumor tissue from that patient. Mutations specific to the tumor, termed "neo-antigens", would be an ideal target for immunotherapy, with the hope of not inducing an immune response anywhere else in the patient's body. A list of these mutations would be generated, filtering out mutations that do not change the amino acid sequence of the patient's proteins. This list would be used to generate a list of short peptides (8-12 amino acids for class I MHC and 12-17 amino acids for class II MHC) that would contain these mutations. The peptide list would then be converted to short oligonucleotide sequences that contain the genetic encoding of those peptides flanked by the nucleotide sequences required for cloning into the SABR vector. These oligonucleotides would be synthesized and then cloned into the vector, using whatever molecular techniques are appropriate. Then that vector will be put in cells, using appropriate techniques. In our case, we used the In-Fusion kit that simplifies Gibson assembly to clone the vector. We generated lentivirus from the resultant plasmid, and infected NFAT-GFP-Jurkat cells. This batch of cells, each expressing a unique SABR, is what we call the SABR library. Overall, each cell contains an MHC molecule linked to a unique short peptide with a tumor mutation, and those MHC molecules are directly linked to a signaling domain, creating a SABR. Enough cells were infected with lentivirus so that the batch of cells cover all mutations in the list of short peptides.

To use the library to find a patient-specific therapy, the same tumor biopsy would be sequenced for RNA of TCR alpha and beta fragments. These fragments are from T cells that were invading the tumor in an attempt to suppress the tumor, known as tumor-infiltrating lymphocytes (TILs). Individual TCRs from these cells would be reconstructed from the sequencing, a fragment of DNA containing that TCR sequence would be synthesized and cloned into a vector, using whatever techniques are appropriate. Lentivirus of that plasmid would be generated and Jurkat cells (without the NFAT-GFP reporter) would be infected with that virus. The candidate TCR cells would then be co-incubated with the SABR library, for about 8 hours, then sorted on FACS sort for cells that show positive signal. In our case, the reporters were GFP and expression of CD69 cell marker. Genomic DNA from the sorted cells would be extracted, sequenced, and analyzed to determine which specific antigen is recognized by the candidate TCR. In our case, the genomic DNA was extracted with the NucleoSpin column extraction kit, PCR amplified with primers flanking the genetically encoded antigen sequence, re-amplified with primers specific for illumina sequencing, and sequenced. The resultant sequencing data was compared to a database of the short peptide sequences, and if the TCR recognizes those peptides, we expect to see an enriched genetic sequence in the pool of extracted genomic DNA.

If the TCR recognizes a mutation sequence, but not the unmutated sequence, it would be a good candidate for immunotherapy. That would involve extracting immune cells from the patient, using whatever technique desired to make those cells express the desired TCR, and infusing those adoptive cells back into the patient so that they can start attacking the tumor.

Figure 12A:
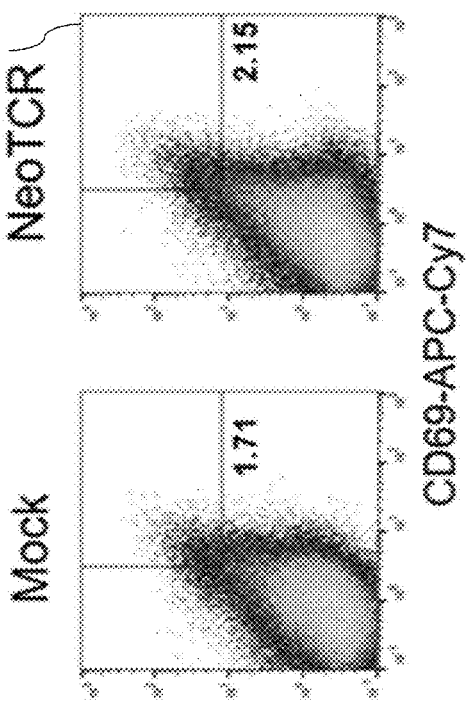
FIG. 12A illustrates a representative flow cytometry plots.

To further demonstrate the versatility of SABR libraries, a personalized approach for neoantigen discovery was tested. A recent study identified a neoantigen-specific, tumor-reactive TCR from a melanoma patient using DNA-barcoded tetramers. The identified TCR (neoTCR) was shown to recognize a neoantigen epitope created by a non-synonymous mutation in the USP7 protein. The SABR library approach was used to identify the neoantigen epitope recognized by the neoTCR by screening all possible neoepitopes identified in the tumor sample. To that end, a SABR library presenting 3291 predicted HLA-A*0201-restricted epitopes (NeoAg-SABR library) corresponding to 108 non-synonymous mutations found in the tumor was generated. The neoTCR was used as a surrogate for a tumor-reactive orphan TCR and the NeoAg-SABR library was used to identify its antigen. Jurkat cells transduced with neoTCR were co-cultured with NFAT-GFP-Jurkat cells expressing the NeoAg-SABR library, GFP+CD69+ cells were sorted, and epitopes from the sorted cells were sequenced and ranked. FIG. 12A illustrates a representative flow cytometry plots from one replicate. NeoAg-SABR library cells based on reporter gene expression were sorted. Co-culture assays using 6 million library cells with 6 million TCR-transduced Jurkat cells were set up. At 10 hours post co-culture, cells were stained for CD69 and sorted using FACS. The rectangle 1202 in the top right corner of each flow plot shows the gate used for the sort. The frequency of cells in the sort gate is indicated as percentage.

Figure 12B:
FIG. 12B illustrates a plot of average ranks from neoTCR and mock sorts.

For each epitope, the average ranks from the neoTCR sort against a mock-sort were plotted. FIG. 12B illustrates a plot of the average ranks from the neoTCR and the mock sorts. Within FIG. 12B, each dot represents the average rank for a unique epitope as calculated using the procedure described in FIGS. 10A-10C. The Y-axis shows average rank in the neoTCR sort, and the X-axis shows the average rank in the mock sort. Dots 1204 indicate USP7-derived epitopes. Seven epitopes formed a distinct cluster separated by their rank in the neoTCR sort.

Figure 12D:
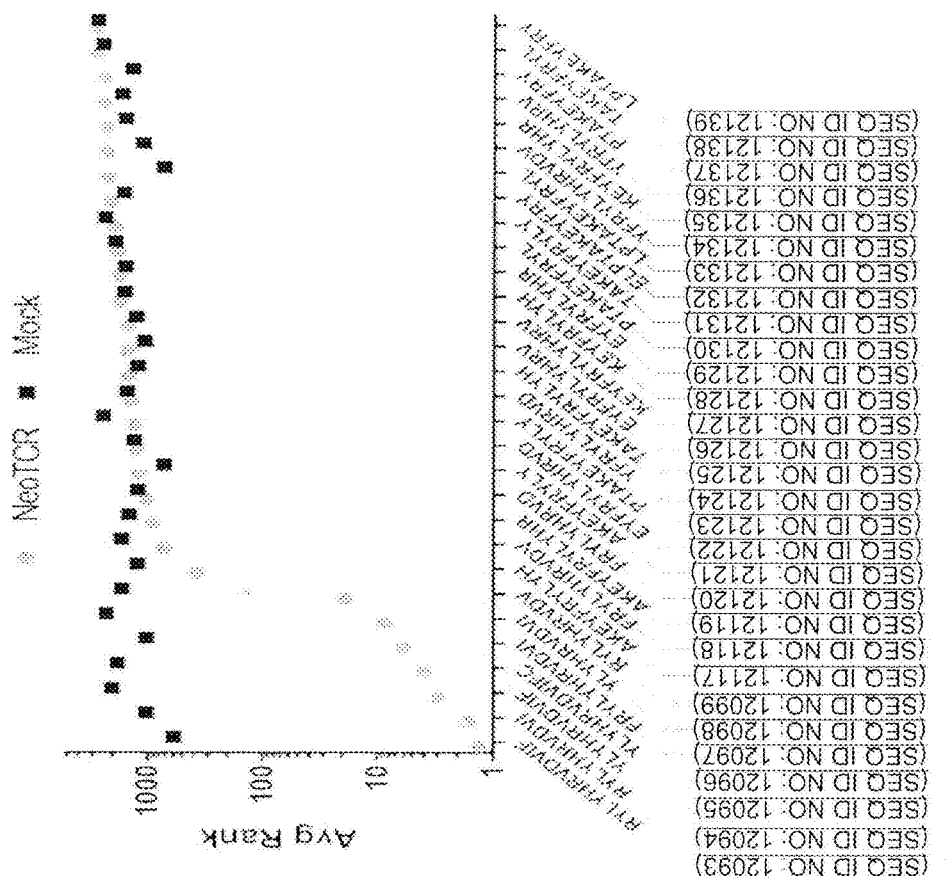
FIG. 12D illustrates a plot of average ranks for USP7-derived epitopes in a NeoAg-SABR library.
Figure 12C:
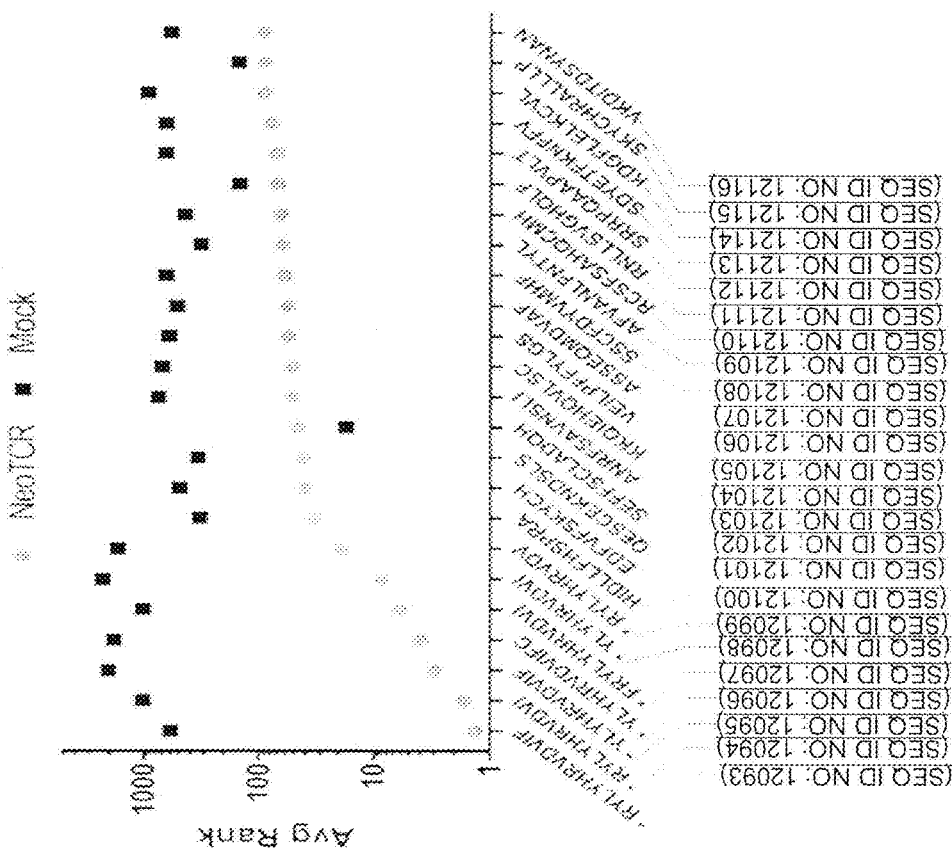
FIG. 12C illustrates a plot of average ranks for hits from a neoTCR sort.

FIG. 12C illustrates a plot of the average ranks for the top 24 hits from the neoTCR sort. Epitopes with asterisks indicate USP7-derived epitopes. The top seven hits in the neoTCR sort were epitopes derived from USP7, demonstrating successful identification of the neoantigen using our approach.

Figure 12E:
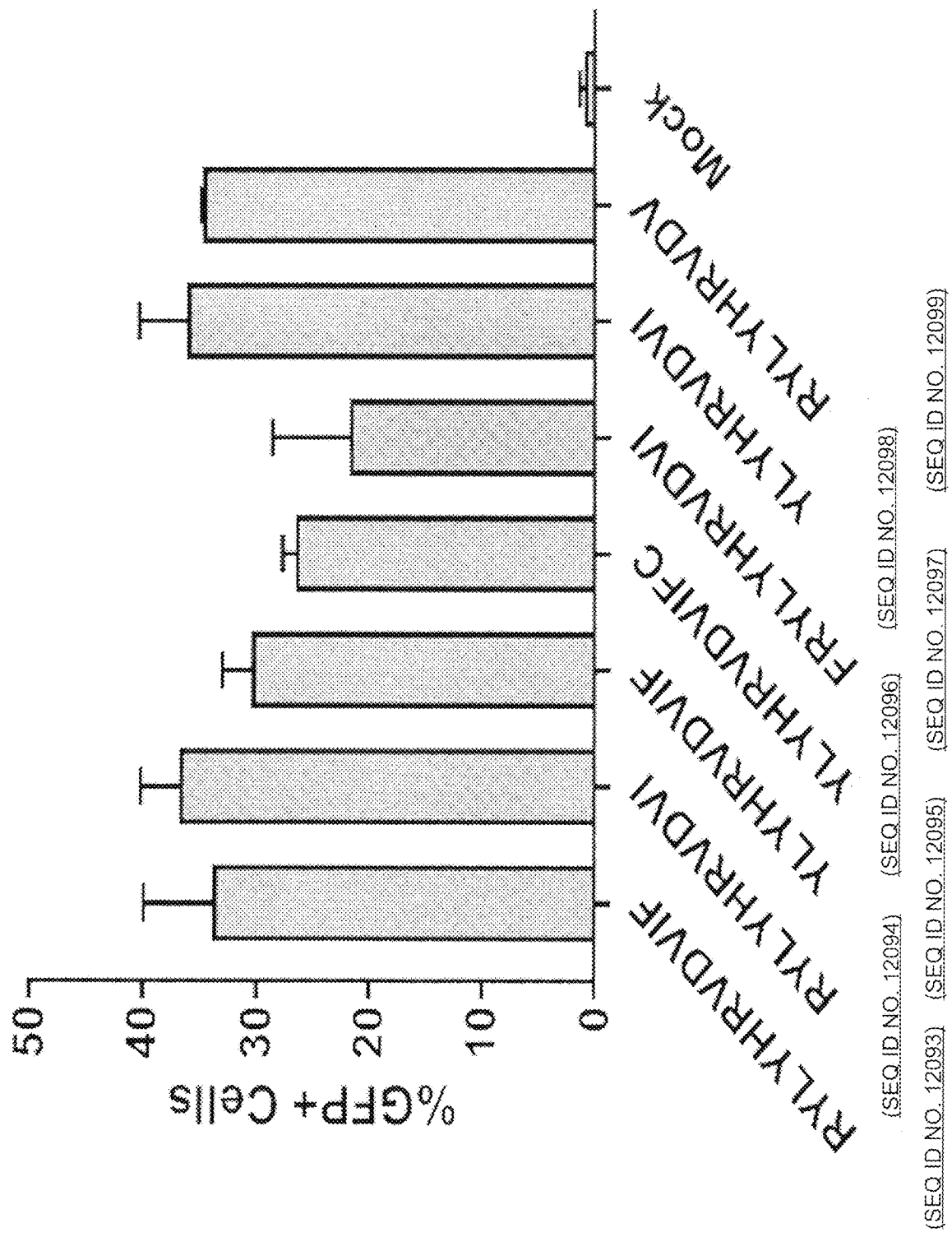
FIG. 12E illustrates a plot showing validation of top hits identified in a NeoAg-SABR screen.

FIG. 12D illustrates a plot of the average ranks for all the USP7-derived epitopes in the NeoAg-SABR library. The non-synonymous D798Y mutation in USP7 was predicted to generate thirty overlapping neoepitopes, out of which seven were identified as cognate epitopes of neoTCR. The reason the remaining 23 epitopes were not recognized in the screen is probably due to the restricted register of the epitope recognized by the neoTCR. To validate the seven detected epitopes, individual SABRs to present them were constructed. NFAT-GFP-Jurkat cells transduced with these SABRs induced GFP expression upon co-culture with Jurkat cells expressing neoTCR, as shown in FIG. 12E. FIG. 12E illustrates a plot showing validation of top hits identified in the NeoAg-SABR screen. The Y-axis shows GFP expression at 8 hours in NFAT-GFP-Jurkat cells co-cultured with Jurkat cells transduced with neoTCR. Co-culture assays were set up using 10,000 Jurkat cells transduced with neoTCR and 10,000 NFAT-GFP-Jurkat cells expressing SABRs presenting epitopes indicated on the X-axis. The mock comprised untransduced NFAT-GFP-Jurkat cells. Within FIG. 12E, the bars represent mean±sd, n=4.

These results demonstrate validation as well as successful personalization of the antigen discovery approach presented herein. Collectively, the results demonstrate that the SABRs are powerful tools for T cell antigen discovery.

Example 6

Materials and Methods

The specific reagents used in Examples 1-5 are detailed in Table 6.1. The oligonucleotide primers used for cloning and sequencing are listed in Table 6.2. The lists of epitopes in the A2-SABR libraries are listed in Tables 6.3

TABLE 6.1

| Product Name | Manufacturer/Source | Cat. No |
| --- | --- | --- |
| Jurkat Cells, Clone E6-1 | ATCC, Manassas, VA | TIB-152 |
| NFAT-GFP-Jurkat Cells | Provided by Arthur Weiss and Yvonne Chen | N/A |
| Primary T Cells | UCLA, CFAR Virology Core | N/A |
| HEK-293T Cells | ATCC, Manassas, VA | CRL-3216 |
| RPMI 1640, 1X with L-glutamine | Corning ™, Corning, NY | 10-040-CV |
| 10% Fetal Bovine Serum | Corning ™, Corning, NY | 35-015-CV |
| Penicillin-Streptomycin Solution, 100X | Corning ™, Corning, NY | 30-002-CI |
| G-418 Sulfate | Corning ™, Corning, NY | 30-234-CI |
| Immunocult ™ CD3/28 T Cell Activator | StemCell Technologies ™, Vancouver, Canada | 10991 |
| Human IL-2 IS, premium grade | MACS Miltenyi Biotec, Bergisch Gladbach, Germany | 130-097-746 |
| EAAGIGILTV | Synthesized by Pierce Thermo Fisher | N/A |
| KRWIILGLNK | Synthesized by Pierce Thermo Fisher | N/A |
| DMEM, 1X with L-Glutamine, 4.5 g/L Glucose and Sodium Pyruvate | Corning ™, Corning, NY | 10-013-CV |
| Clontech In-Fusion ® HD Cloning Kit | Clontech, Takara Bio USA, Mountain View, CA | 639650 |
| BsmBI | New England BioLabs ®, Inc, Ipswich, MA | R0580S |
| Clontech Stellar ™ Competent Cells | Clontech, Takara Bio USA, Mountain View, CA | 636763 |
| Zyppy ™ Plasmid Miniprep Kit | Zymo Research, Irvine, CA | D4036 |
| Carbenicillin (disodium) | Gold Biotechnology ®, Saint Louis, MO | C-103-SL10 |
| NucleoBond ® Xtra Maxi EF Kit | Clontech, Takara Bio USA, Mountain View, CA | 740424.50 |
| TransIT ®-293 Transfection Reagent | Mirus ® Bio, LLC Madison, WI | MIR 2704 |
| Gibco ™ Opti-MEM ™ I Reduced Serum Medium | Life Technologies, Thermo Fisher Scientific, Waltham, MA | 31985-062 |
| Millex ®-HV Syringe Filter Unit, 0.45 µm, PVDF, 33 mm, gamma sterilized | EMD Millipore, Burlington, MA | SLHV033RS |
| MACSQuant ® Analyzer 10 | MACS Miltenyi Biotec, Bergisch Gladbach, Germany | 130-096-343 |
| APC/Cy7 anti-human CD69 Clone: FN50 | BioLegend ®, San Diego, CA | 310913 |
| BD FACSort ™ | Becton Dickinson, Franklin Lakes, NJ | |
| CFSE Cell Division Tracker Kit | BioLegend ®, San Diego, CA | 423801 |
| Invitrogen ™ PureLink ™ Genomic DNA Mini Kit | Invitrogen ™ Life Technologies, Thermo Fisher Scientific, Waltham, MA | K182001 |
| KOD DNA Polymerase | EMD Millipore, Burlington, MA | 71085 |
| Macherey-Nagel NucleoSpin ® Gel and PCR Purification Kit | Clontech, Takara Bio USA, Mountain View, CA | 740609.250 |
| 2100 Bioanalyzer Instrument | Agilent, Santa Clara, CA | G2939BA |
| Ilumina ® HiSeq 2500 Sequencing System | Illumina ® San Diego, CA | SY-401-2501 |
| TreeStar FlowJo ® Flow Cytometric Data Analysis Software v10 | FlowJo, LLC Ashland, Oregon | N/A |
| GraphPad Prism v7 | GraphPad, San Diego, California | N/A |

TABLE 6.2

| Primer name | Sequence (5'-3') | Purpose |
|---|---|---|
| SS-Fwd | AGCTCCTCGAGATGGCGACGGGTTCAAG (SEQ ID NO: 12138) | SABR cloning |
| CD28-Overlap-HLA-A2-Rev | CCACCGCGAGACCTCTTGCTCCGCACTTTA CAAGCTGTGAGAGACACA (SEQ ID NO: 12139) | SABR cloning |
| CD28-Overlap-HLA-B27-Rev | CCACCGCGAGACCTCTTGCTCCGAGCTGTG AGAGACACATCAGAGC (SEQ ID NO: 12140) | SABR cloning |
| CD28Intracell-Fwd | CGGAGCAAGAGGTCTCGC (SEQ ID NO: 12141) | SABR cloning |
| XhoI-CD3z-Rev | TTGACCTCGAGTCATCTTGGTGGCAGAGCC (SEQ ID NO: 12142) | SABR cloning |
| Oligo-Insert-Fwd | CAGGAGGGCTCGGCA (SEQ ID NO: 12143) | Cloning epitopes in SABRs |
| Oligo-Insert-Rev | GGACCCTCCGCATCC (SEQ ID NO: 12144) | Cloning epitopes in SABRs |
| Epitope-Oligo | CAGGAGGGCTCGGCA NNN . . . NNN GGATGCGGAGGGTCC (SEQ ID NO: 12145) | Cloning epitopes in SABRs |
| TruSeq-Univ-SCTfixed-F | AATGATACGGCGACCACCGAGATCTACAC TCTTTCCCTACACGACGCTCTTCCGATCTG GCCTGCTTTGTTTGCC (SEQ ID NO: 12146) | High throughput sequencing |
| TruSeq-Read2-SCTfixed-R | GTGACTGGAGTTCAGACGTGTGCTCTTCCG ATCTCCTCCACCACCGCTACCTC (SEQ ID NO: 12147) | High throughput sequencing |
| Truseq-Adapter-Index | CAAGCAGAAGACGGCATACGAGAT[index] GTGACTGGAGTTCAGACGTGTGCTCTTCCG ATCT (SEQ ID NO: 12148) | High throughput sequencing |

Within Table 6.2, NNN . . . NNN indicates a back-translated epitope and [index] indicates the 6-nucleotide unique index used for sequencing.

For Examples 1-5, Jurkat cells (ATCC) were cultured in R10 (RPMI1640 (Corning) supplemented with 10% fetal bovine serum (Corning) and Penicillin/Streptomycin (Corning)). NFAT-GFP-Jurkat cells were cultured in R10 supplemented with 2 mg/ml G-418 (Corning). Primary T cells were activated in R10 supplemented with Immunocult CD3/28 (StemCell Technologies) and 40 U/ml IL-2 (Miltenyi Biotec). HEK-293T cells (ATCC) were cultured in D10 (DMEM (Corning) supplemented with 10% fetal bovine serum (Corning) and Penicillin/Streptomycin (Corning)). Peptides EAAGIGILTV and KRWIILGLNK were synthesized by Pierce Thermo Fisher.

For constructing the SABRs of Examples 1-5, single molecules encoding for β2-microglobulin and HLA were synthesized as gBlocks (IDT) and amplified using primers SS-Fwd and CD28-Overlap-HLA-Rev. CD3ζ/CD28 signaling domains were cloned from the J3 CAR using primers CD28Intracell-Fwd and XhoI-CD3z-Rev. The two parts of SABRs were assembled via PCR or via InFusion HD cloning kit (Takara). A synthetic 2 kb fragment of non-specific stuffer DNA (IDT) flanked by BsmBI sites was cloned in place of the epitope. To clone a given epitope into a SABR vector, the vector was first linearized by BsmBI digestion (NEB) and gel purified using Nucleospin Gel and PCR kit (Takara). A single stranded oligonucleotide containing overlaps with the vector and the epitope was synthesized (IDT). The oligonucleotides were amplified using KOD polymerase (Milipore) and Oligo-Insert-Fwd and Oligo-Insert-Rev. Amplified oligonucleotide was cloned into the linearized SABR vector using InFusion HD cloning kit (Takara). All cloning reactions were transformed into Stellar competent cells (Takara), grown on LB+Agar plates containing 100 μg/ml Carbenicillin (Life Technologies), and individual colonies were inoculated in liquid culture. Plasmid minipreps were performed using Zyppy Miniprep kit (Zymo). Plasmids were verified by Sanger sequencing (Laragen).

For TCR cloning of Examples 1-5, sequences for the F5, SL9, and neoTCR were synthesized as gBlocks (IDT) and cloned in the pCCLc-MND-X backbone along with a truncated form of LNGFR gene as previously described. EC27 TCR was cloned as described previously.

To generate lists of epitopes to be cloned into SABR vectors in Examples 1-5, two approaches were taken. In the universal A2-SABR library, all HLA-A*0201-restricted epitopes from Immune Epitope Database (IEDB) were downloaded. In the neoantigen SABR library, HLA-A*0201-restricted neoepitopes generated from the tumor mutanome data were used. Protein sequences were back-translated to nucleotide sequences using the most abundant codon for each amino acid based on the GenScript Codon Usage Frequency Table Tool (GenScript). Oligonucleotides encoding for the epitopes and containing overlaps with the SABR vector were synthesized in pooled single stranded oligonucleotide libraries (Twist Biosciences). Oligonucleotide libraries were amplified and cloned into the SABR vector as described previously. To ensure sufficient coverage, bacterial cells transformed with the cloning reaction were inoculated directly into 500 ml liquid cultures overnight. The plasmid DNA containing the libraries was prepared using Nucleobond Xtra Maxi Plus EF.

Lentiviral vectors to express SABRs or TCRs were packaged using previously described procedures. Briefly, 5,000,000 HEK-293T cells were plated on poly-L-Lysine coated plates for 24 hours, followed by transfection of a mixture of the lentiviral shuttle plasmid, pMDG-VSVG, and pCMV-RD8.9 using TransIT-293 (Mirus Bio) and OPTI-MEM (Life Technologies). Viruses were filtered through 0.45 micron syringe filters (Milipore) and stored at −80° C. until further use. To transduce Jurkat, NFAT-GFP-Jurkat, or Primary T cells, 2-5×10$^5$ cells were plated in culture medium and mixed with an equal volume of thawed virus in 12-well plates for three days. For NFAT-GFP-Jurkat cells, G-418 was added to the transduction mixture 48 hours later.

Figure 13A:
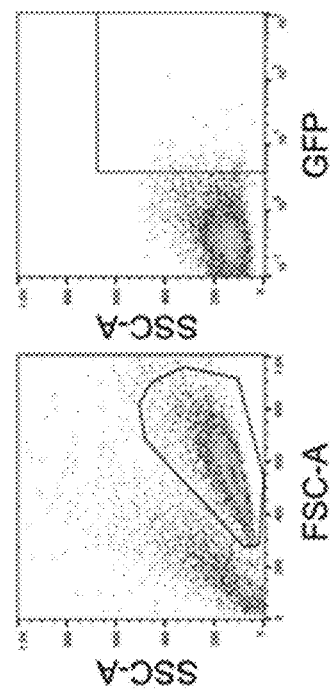
FIG. 13A illustrates a plot of a gating strategy used in co-culture assays to measure GFP expression.
Figure 13B:
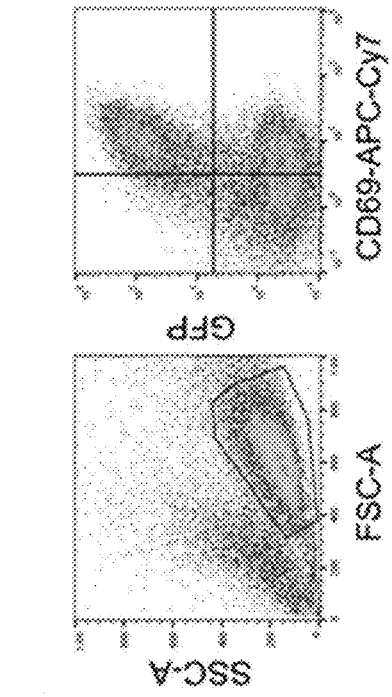
FIG. 13B illustrates a plot of a gating strategy used in co-culture assays to measure GFP and CD69 expression.
Figure 13C:
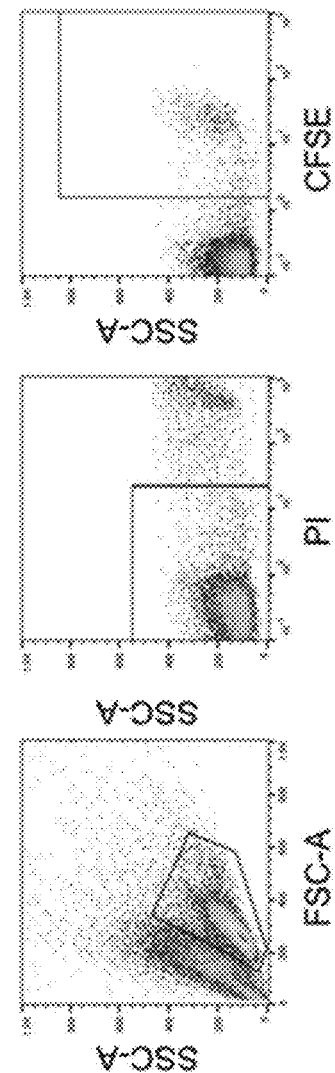
FIG. 13C illustrates a plot of a gating strategy used in cytotoxicity assays.

For the co-culture assays to test SABR signaling in Examples 1-5, 1-5×10$^4$ transduced NFAT-GFP-Jurkat cells were incubated with equal number of transduced Jurkat cells on 96 well flat or round bottom plates for 8-10 hours. The cells were then acquired on MACSQuant (Miltenyi) or stained with anti-CD69-APC-Cy7 (Biolegend Clone #) and then acquired on MACSQuant (Miltenyi). For the SABR library assays, 1.5×10$^6$ SABR library cells were incubated with 1.5×10$^6$ Jurkat cells in each well of a 6 well plate. At 8-10 hours after co-culture, cells were harvested, stained with anti-CD69-APC-Cy7 (Biolegend), and sorted on a BD FACS SORP (Becton-Dickinson). Cytotoxicity assays were performed using target cells labeled with CFSE (Biolegend) as described previously. For the empty SABR assays, transduced NFAT-GFP-Jurkat cells were incubated with 100 mg/ml of soluble peptide for 2 hours at 37° C. Equal numbers of transduced Jurkat cells were then added to the cells, followed by 8-10 hours of co-culture. Gating strategies for these assays is shown in FIGS. 13A-13C. FIG. 13A illustrates a plot of the gating strategy used in co-culture assays to measure GFP expression. FIG. 13B illustrates a plot of the Gating strategy used in co-culture assays to measure GFP and CD69 expression. FIG. 13C illustrates a plot of the gating strategy used in cytotoxicity assays.

For the high-throughput sequencing and analysis of Examples 1-5, genomic DNA was extracted from sorted cells immediately following sorting using PureLink genomic DNA extraction kit (Life Technologies). The SABR vectors were amplified using KOD polymerase (Milipore) and 10:1:10 mixture of primers TruSeq-Univ-SCTfixed-F, TruSeq-Read2-SCTfixed-R, and Truseq-Adapter-Index respectively. For each sample, 5-10 reactions using 1-30 ng of genomic DNA were performed for 30-35 cycles. The reactions were pooled and purified using Nucleospin Gel and PCR purification kit (Takara). The purified PCR product was analyzed on Bioanalyzer (Agilent) and subjected to sequencing on HiSeq 2500 (Illumina). Unaligned reads generated by the sequencer were stored in FASTQ files. The reads were first aligned to the SABR vector using Burrows-Wheeler Alignment with a mismatch penalty of $1^{22}$. For each aligned read, the epitope was translated and counted. All epitopes were ranked according to the number of reads, and an average rank was calculated for each read. The average rank was then used for further analysis.

Flow cytometry plots were analyzed on FlowJo (Treestar). Statistical analyses and graphical representations were generated by Microsoft Excel (Microsoft) and GraphPad Prism (Graphpad).

The list of epitopes in the SABR libraries can be found in Tables 6.3.

---

Lengthy table referenced here

US12221465-20250211-T00001

Please refer to the end of the specification for access instructions.

In some embodiments, any of the epitopes in Table 6.3 can be employed as the epitope in the SABR arrangement provided herein. In some embodiments, any of the epitopes in table 6.4 can be used as the epitope in the SABR arrangements provided herein.

TABLE 6.4

| Epitope | Nucleic Acid | Amino Acid | Parent Organism |
|---|---|---|---|
| CMV pp65 (495 - 503) | AATCTGGTTCCGATGGTTGCCACAGTA (SEQ ID NO: 12149) | NLVPMVATV (SEQ ID NO: 12150) | Cytomegalovirus (CMV) |
| EBV BMLF-1 (280 - 288) | GGCCTGTGTACGTTGGTGGCTATGCTG (SEQ ID NO: 12151) | GLCTLVAML (SEQ ID NO: 12152) | Epstein-Barr Virus (EBV) |
| GAD65 (114- 123) | GTTATGAACATTTTGCTGCAGTACGTGGTG (SEQ ID NO: 12153) | VMNILLQYVV (SEQ ID NO: 12154) | Homo sapiens |
| GAD65 (339 - 352) | ACAGTCTACGGGGCATTCGACCCTCTGCTGG CCGTAGCAGAT (SEQ ID NO: 12155) | TVYGAFDPLL AVAD (SEQ ID NO: 12156) | Homo sapiens |
| glia-a (228 - 240) | TCAGGGGAGGGCAGCTTCCAGCCGTCTCAAG AAAATCCG (SEQ ID NO: 12157) | SGEGSFQPSQ ENP (SEQ ID NO: 12158) | Common wheat (Triticum aestivum) |

TABLE 6.4-continued

| Epitope | Nucleic Acid | Amino Acid | Parent Organism |
|---|---|---|---|
| glia-a1a (60-68) | CCCTTCCCCCAGCCCGAGCTGCCCTAC (SEQ ID NO: 12159) | PFPQPELPY (SEQ ID NO: 12160) | Common wheat (*Triticum aestivum*) |
| IA-2 (797-805) | ATGGTATGGGAGAGCGGATGTACTGTG (SEQ ID NO: 12161) | MVWESGCTV (SEQ ID NO: 12162) | *Homo sapiens* |
| IGRP (265-273) | GTCCTCTTTGGTCTTGGGTTCGCAATC (SEQ ID NO: 12163) | VLFGLGFAI (SEQ ID NO: 12164) | *Homo sapiens* |
| Insulin B (10-18) | CACCTCGTCGAGGCATTGTACCTCGTG (SEQ ID NO: 12165) | HLVEALYLV (SEQ ID NO: 12166) | *Homo sapiens* |
| Insulin B (9-23) | AGCCACCTGGTGGAGGCCCTGTACCTGGTGT GCGGCGAGAGGGGC (SEQ ID NO: 12167) | SHLVEALYLV CGERG (SEQ ID NO: 12168) | *Homo sapiens* |
| KK10 | AAAAGATGGATAATCCTGGGATTAAATAAA (SEQ ID NO: 12169) | KRWIILGLNK (SEQ ID NO: 12170) | human immunodeficiency virus (HIV) |
| LLO (190-205) | AACGAGAAGTACGCCCAGGCCTACCCCAACG TGAGCGCCAAGATCGAC (SEQ ID NO: 12171) | NEKYAQAYP NVSAKID (SEQ ID NO: 12172) | Listeria monocytogenes |
| MART1 | GAGGCCGCCGGCATCGGCATCCTGACCGTG (SEQ ID NO: 12173) | EAAGIGILTV (SEQ ID NO: 12174) | *Homo sapiens* |
| MART1-A27L | GAGCTGGCCGGCATCGGCATCCTGACCGTG (SEQ ID NO: 12175) | ELAGIGILTV (SEQ ID NO: 12176) | Synthetic |
| NYESO | AGCCTGCTGATGTGGATCACCCAGTGC (SEQ ID NO: 12177) | SLLMWITQC (SEQ ID NO: 12178) | *Homo sapiens* |
| NYESO-1V | TCCCTGCTGATGTGGATCACCCAGGTG (SEQ ID NO: 12179) | SLLMWITQV (SEQ ID NO: 12180) | Synthetic |
| OVA (257-264) | AGCATCATCAACTTCGAGAAGCTG (SEQ ID NO: 12181) | SIINFEKL (SEQ ID NO: 12182) | chicken (*Gallus gallus domesticus*) |
| OVA (323-339) | ATAAGCCAGGCCGTTCATGCTGCACATGCAG AAATAAACGAGGCTGGCAGA (SEQ ID NO: 12183) | ISQAVHAAHA EINEAGR (SEQ ID NO: 12184) | chicken (*Gallus gallus domesticus*) |
| PPI (15-24) | GCACTCTGGGGTCCTGATCCGGCTGCGGCT (SEQ ID NO: 12185) | ALWGPDPAA A (SEQ ID NO: 12186) | *Homo sapiens* |
| ProIns C19-35 | GGCGCCGGCAGCCTGCAGCCCCTGGCCCTG AGGGCAGCCTGCAGAAGAGG (SEQ ID NO: 12187) | GAGSLQPLAL EGSLQKR (SEQ ID NO: 12188) | *Homo sapiens* |
| ProIns C19-A3 | GGAAGTTTGCAGCCATTGGCTCTGGAAGGGA GCCTGCAAAACGCGGCATTGTA (SEQ ID NO: 12189) | GSLQPLALEG SLQKRGIV (SEQ ID NO: 12190) | *Homo sapiens* |

TABLE 6.4-continued

| Epitope | Nucleic Acid | Amino Acid | Parent Organism |
|---------|--------------|------------|-----------------|
| ProIns C19-A3 L3W | GGAAGTTTGCAGCCATTGGCTTGGGAAGGGA GCCTGCAAAAACGCGGCATTGTA (SEQ ID NO: 12191) | GSLQPLAWEG SLQKRGIV (SEQ ID NO: 12192) | Synthetic |
| SL9 | TCATTATATAATACAGTAGCAACCCTC (SEQ ID NO: 12193) | SLYNTVATL (SEQ ID NO: 12194) | human immunodeficiency virus (HIV) |

Example 7

Antigen presenting Cells to Detect Islet Autoimmunity in Type 1 Diabetes

Type 1 Diabetes (T1D) is an autoimmune disorder caused by progressive destruction of insulin-producing pancreatic β cell islets. The role of T cells in pathology of T1D is well established by immunological studies and discovery of genetic risk factors. However, there is an unmet need for tools to link the immune manifestations of these genetic risk factors.

An immune-reactive cell, such as a pancreatic β cell in T1D, presents antigenic epitopes on human leukocyte antigen molecules (pHLA complexes) on its surface. T cells use their unique TCR to specifically recognize pHLA. In T1D, both CD4+ and CD8+ T cells recognize and respond to self-antigens on pancreatic β cells. CD8+ T cells recognize Class I pHLA and induce a cytotoxic response, whereas, CD4+ T cell recognize Class II pHLA and induce a helper response that modulates immune function. A bottleneck in studying T cells is at the identification of the antigens they target. Two major tools to detect the antigen-specific T cells are pHLA-multimers and functional assays. pHLA multimers are purified HLA molecules complexed with peptides and conjugated to fluorophores and are used to identify antigen-specific T cells by flow cytometry. Despite their extensive use, they have several limitations: Class II pHLA multimers are inherently unstable, in particular, those for alleles associated with increased risk for T1D (HLA-DQ2 and -DQ8) and are therefore difficult and non-robust to use, they do not represent the physiological immune synapse, and they fail to detect low-avidity T cells inherently associated with autoimmunity. Functional assays, such as ELISAs and ELISPOTs, efficiently detect T cell function by measuring cytokine production upon stimulation with Antigen Presenting Cells (APCs) presenting desired epitopes. However, these assays do not allow distinction between different pHLAs, as APCs have three to ten different HLA alleles. They are also reliant on the induction of a strong functional response such as IFNγ secretion and thus cannot detect functionally impaired autoimmune T cells. The detection of antigen-specific regulatory T cells (Tregs) is particularly challenging as their activity inhibits typically measured responses, and therefore is masked in functional assays as negative response. Indeed, there is an unmet need for detection of antigen-specific Tregs.

Figure 14B:
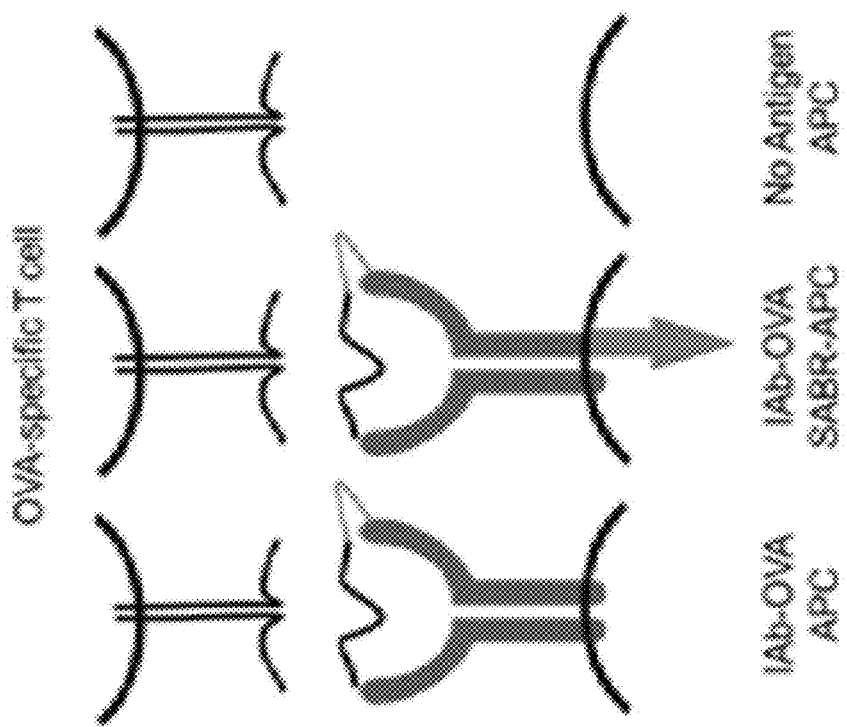
FIG. 14B illustrates a schematic of a SABR showing induction of a signal by a SABR presenting Ovalbumin peptide on a mouse class II pMHC (IAb-OVA) upon recognition by cognate T cells.
Figure 14A:
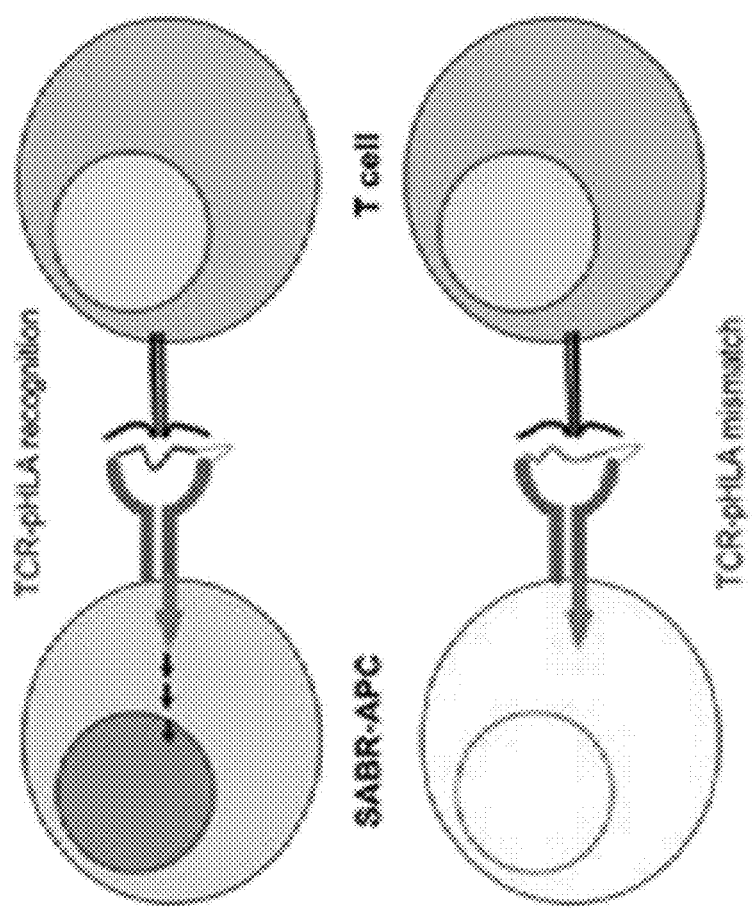
FIG. 14A illustrates a schematic showing the structure of a SABR and signal induction by SABRs upon TCR-pHLA recognition.
Figure 14C:
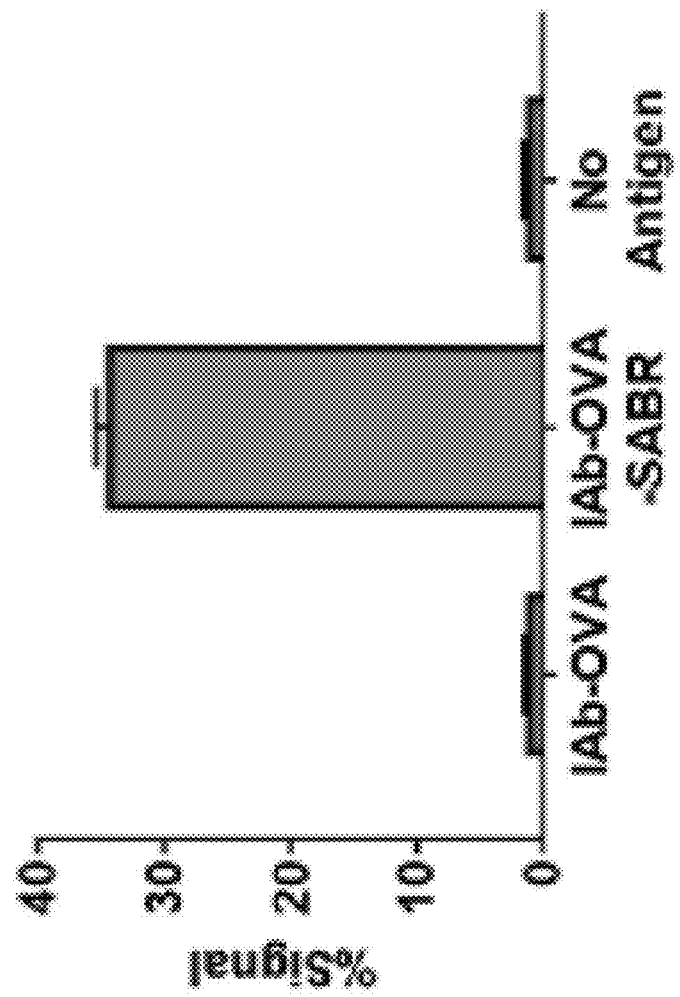
FIG. 14C illustrates a bar graph showing induction of a signal by SABRs presenting Ovalbumin peptide on a mouse class II pMHC (IAb-OVA) upon recognition by cognate T cells.

To that end, SABRs to detect pHLA-TCR interactions were constructed. FIG. 14A illustrates a schematic showing the structure of the SABR and signal induction by SABRs upon TCR-pHLA recognition. The extracellular domain of the SABR used in this example was a pHLA complex, which upon recognition by a T cell, causes the intracellular domain to induce a signal. APCs engineered to express SABRs present a given epitope and induce a measurable output when recognized by cognate T cells. The advantages of SABR-APCs over multimers or functional assays include: physiological pHLA display of single alleles on the surface of an APC, ability to define pHLA combinations genetically, multiplexed detection of epitope specificities, and detection of pHLA-TCR interaction independently from T cell function. FIG. 14B and FIG. 14C demonstrate this technique by showing induction of a signal by a SABR presenting Ovalbumin peptide on a mouse class II pMHC (IAb-OVA) upon recognition by cognate T cells. These SABR-APCs can be used to detect islet-specific immune responses in T1D patients, to study the immunological effects of genetic risk factors, and to interrogate natural and immunotherapy-induced T cells.

Figure 14E:
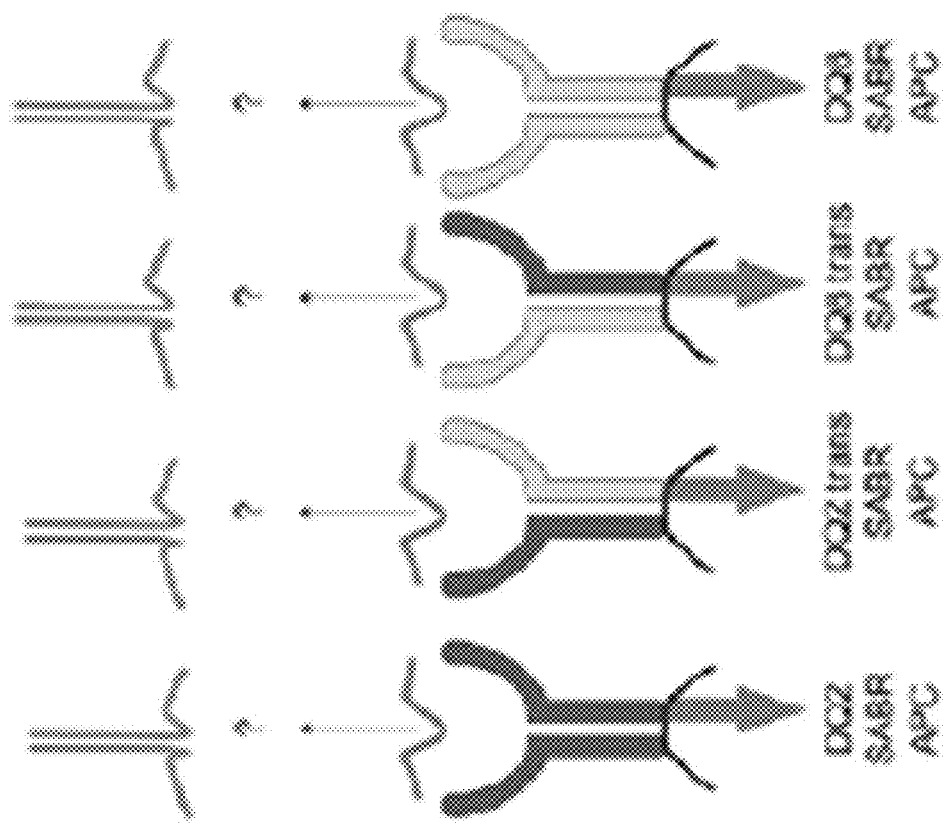
FIG. 14E illustrates SABRs encoding four DQ2/8 combinations on separate APCs allowing their distinction.
Figure 14D:
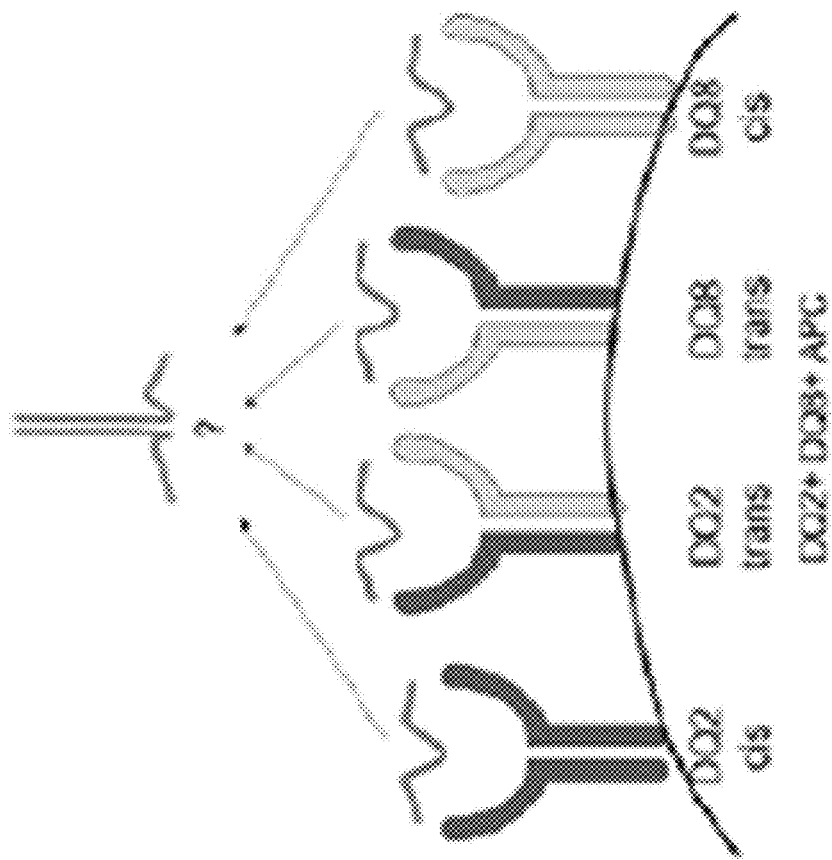
FIG. 14D illustrates four combinations of HLA-DQ alleles on APCs from DQ2-DQ8 heterozygous patients.

The SABR-APCs can be used to understand the immunological mechanism of protective and susceptible genetic risk factors. Several Class II HLA alleles are associated with either protection from or susceptibility to T1D. Both HLA-DQ2 and DQ8 are risk factors for T1D, and particularly, patients who carry both alleles are at significantly higher risk than those carrying either allele alone. This phenomenon is thought to be due to cross-pairing of DQ2 and DQ8 chains (known as DQ2trans or DQ8trans) that may present peptide epitopes and induce autoimmunity. APCs from these patients express correctly paired and cross-paired molecules simultaneously, which cannot be distinguished by current methods, as shown in FIG. 14D. FIG. 14D illustrates four combinations of HLA-DQ alleles on APCs from DQ2-DQ8 heterozygous patients. SABRs can be used to display genetically encoded peptide epitopes linked to specific pairs of such so-called HLA-DQ transdimers on separate APCs to study the differences between patients carrying different genetic risk factors using a rare B-cell line lacking the endogenous DR and DQ locus, as shown in FIG. 14E. FIG. 14E illustrates SABRs encoding four DQ2/8 combinations on separate APCs allowing their distinction. Furthermore, SABR-APCs can be used to distinguish between immunogenicity of protective and susceptible variants of Insulin Defective Ribosomal Products (INS-DRiPs). Thus, the differences between immune responses from individuals carrying different genetic risk alleles can be dissected.

The function of islet autoreactive effector and regulatory T cells using SABR-APCs can also be studied. Autoimmune T cells exhibit unusual modes of antigen recognition and subsequent functional output. For instance, regulatory T cells specific for HLA-DR4-Proinsulin (C19-A3) bind with reversed polarity compared to effector T cells specific for the same epitope. Because of the inherent limitations in pHLA multimers, studying these distinctions has been extremely challenging. Therefore, SABR-APCs presenting these epitopes as substrates can be used for measuring the functional differences between islet-specific T cell clones derived from T1D patients. These studies can be used understand the functional basis of distinct T cell subtypes from the perspective of the APC.

Natural and immunotherapy-induced islet-specific T cell responses can be detected using SABRs. In scenarios of suppressed immune function, current methods fail to detect antigen-specific T cells. This is particularly relevant in scenarios of islet transplantation or immune tolerance observed in healthy individuals or in patients successfully treated with tolerogenic immunotherapy, such as vaccination with Proinsulin C19-A3. Since the technology platform described herein only relies on TCR/epitope/HLA interaction, islet specific effector or regulatory T-cells can be detected and enumerated, even if their response is suppressed. SABR-APCs can be used to diagnose C19-A3-specific T cell responses from patients receiving immunotherapy with tolerogenic dendritic cells pulsed with this immunodominant proinsulin peptide. The use of SABRs can be extended for immunomonitoring by multiplexing detection of several epitopes from the same patient sample, allowing identification of 'immune signatures' in the islet-specific autoimmune responses that may correlate with response to this novel type of tissue specific immune intervention therapy.

Example 8

Class II MHC SABRs

Figure 15A:
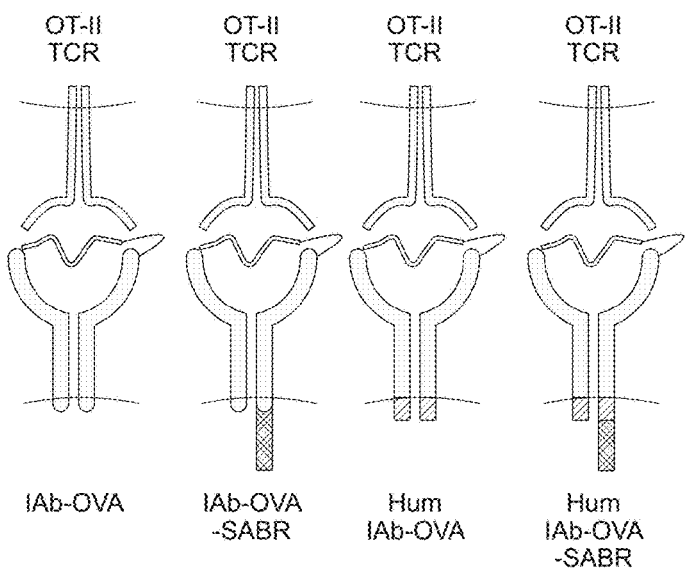
FIG. 15A illustrates a schematic of IAb-OVA and Hum IAb-OVA SABRs and signaling induction upon recognition of an OT-II TCR.
Figure 15B:
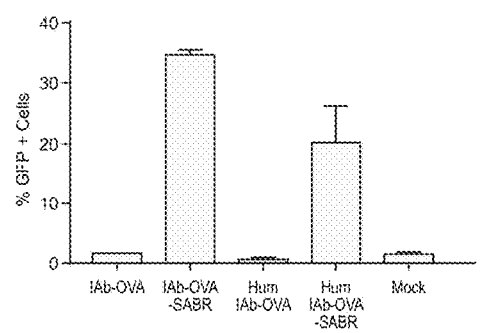
FIG. 15B illustrates a bar graph showing signaling induction upon recognition of OT-II TCR for IAb-OVA and Hum IAb-OVA SABRs.

SABRs comprising antigen presenting domains comprising class II MHC were also tested to determine signaling induction capability. The experimental methods described in Example 1 and 6 were used to test the capacity of class II MHC SABRs. FIG. 15A illustrates a schematic of IAb-OVA and Hum IAb-OVA SABRs and signaling induction upon recognition of an OT-II TCR. FIG. 15B illustrates a bar graph showing signaling induction of OT-II TCR for IAb-OVA and Hum IAb-OVA SABRs. As shown in FIG. 15B, the class II MHC SABRs were capable of inducing a signal while the other constructs did not induce signals. The results show that SABRs comprising class II MHC can induce signaling upon successful and specific TCR-pMHC interaction.

Figure 16A:
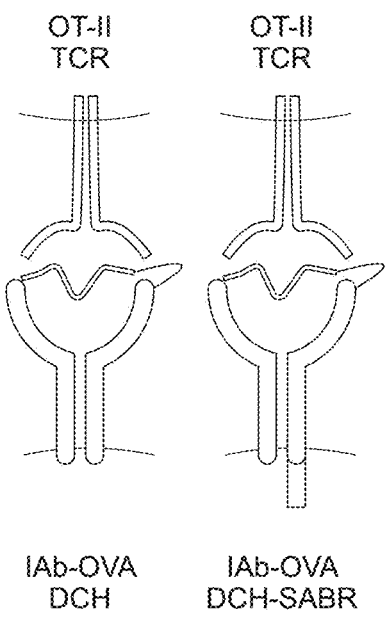
FIG. 16A illustrates a schematic of IAb-OVA DCH and an IAb-OVA DCH-SABR and signaling induction upon recognition of an OT-II TCR.
Figure 16B:
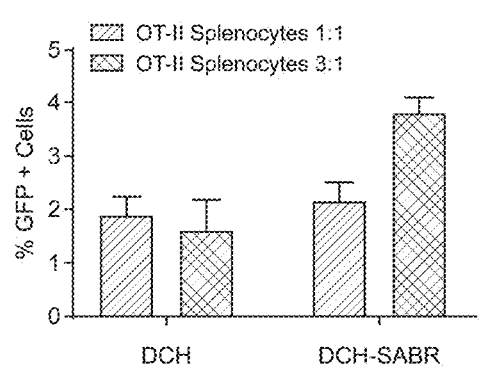
FIG. 16B illustrates a bar graph showing signaling induction upon recognition of mouse splenocytes expressing the OT-II TCR for IAb-OVA and Hum IAb-OVA SABRs.

Furthermore, FIG. 16A illustrates a schematic of IAb-OVA DCH and an IAb-OVA DCH-SABR and signaling induction upon recognition of an OT-II TCR. FIG. 16B illustrates a bar graph showing signaling induction of OT-II TCR for IAb-OVA and Hum IAb-OVA SABRs. These results also show that SABRs comprising class II MHC can induce signaling upon successful and specific TCR-pMHC interaction. Thus, the experiment using Class I MHC SABRs, which are known for being relatively easy to work with, also worked for Class II MHC SABRs, which are known for being difficult to work with traditional methods for antigen discovery described herein.

Example 9

SABRs Recognize Primary Cells

Figures 17A, 17B:
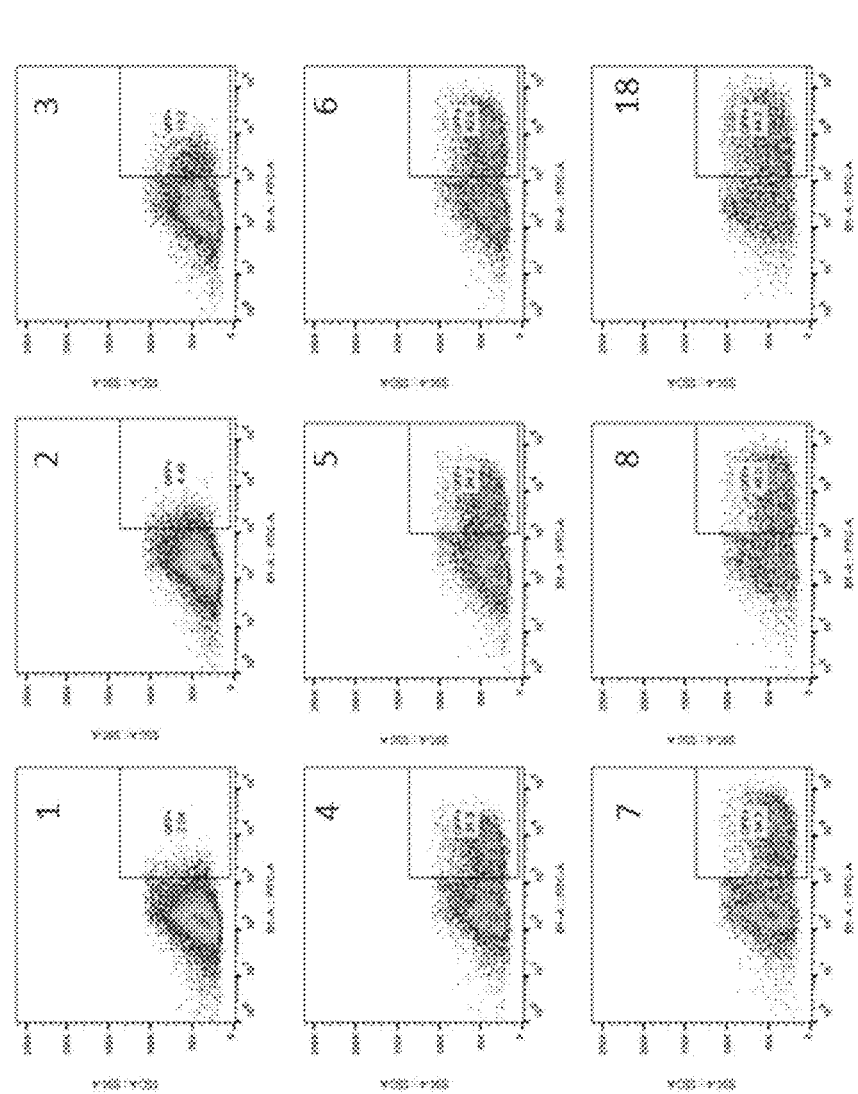
FIG. 17A illustrates a line graph depicting % GFP+ cells over time.
FIG. 17B illustrates representative flow cytometry plots from the experiment.

SCDR constructs were constructed to express, for example, either A2-NYESO (a cancer-specific MHCT antigen combination) or B27-KK10 (an HIV-specific MHC-antigen combination). In some embodiments, the SCDR constructs for A2 and B27 can be constructed and a peptide can be used to present, for example, either NYESO or KK10 antigen. NFAT-GFP-Jurkats, can be transduced with the SCTR constructs or with SCDR constructs and pulsed with peptide antigen as reporter cells. The reporter cells can be transduced with Jurkat cells expressing, for example, either A2-NYESO-specific TCR or B27-KK10-specific TCR, and the frequency of GFP+ cells can be measured with flow cytometry. FIG. 17A illustrates a line graph depicting % GFP+ cells over time. FIG. 17B illustrates representative flow cytometry plots from the experiment.

The results show that a signal was induced in about 30% of reporter cells within 4 hours of incubation and about 50% of reporter cells within 8 hours of incubation. Also, about 50% of the maximal signal was attained at 4 hours and about 100% of the maximal signal was attained by 8 hours.

Using the experimental results of Examples 3 and 6, TCR-transduced Jurkat cells were co-incubated with SCTR-transduced NFAT-GFP-Jurkat cells. FIG. 18A illustrates a bar graph depicting the frequency of % GFP+ for TCR-transduced Jurkat cells incubated with SCTR-transduced NFAT-GFP-Jurkat cells. FIG. 18B illustrates a bar graph depicting the frequency of % GFP+ for TCR-transduced PBMCs incubated with SCTR-transduced NFAT-GFP-Jurkat cells. FIG. 18C illustrates a line graph depicting the frequency over time of % GFP+ for TCR-transduced PBMCs incubated with SCTR-transduced NFAT-GFP-Jurkat cells.

As illustrated in FIGS. 18A-18C, SABRs are able to recognize antigen receptors on primary cells (e.g. directly from patient samples), the same way they recognize transgenic antigen receptors in cell lines.

Species, Variants, Deletions, or Modified Versions of Embodiments

Figure 20A:
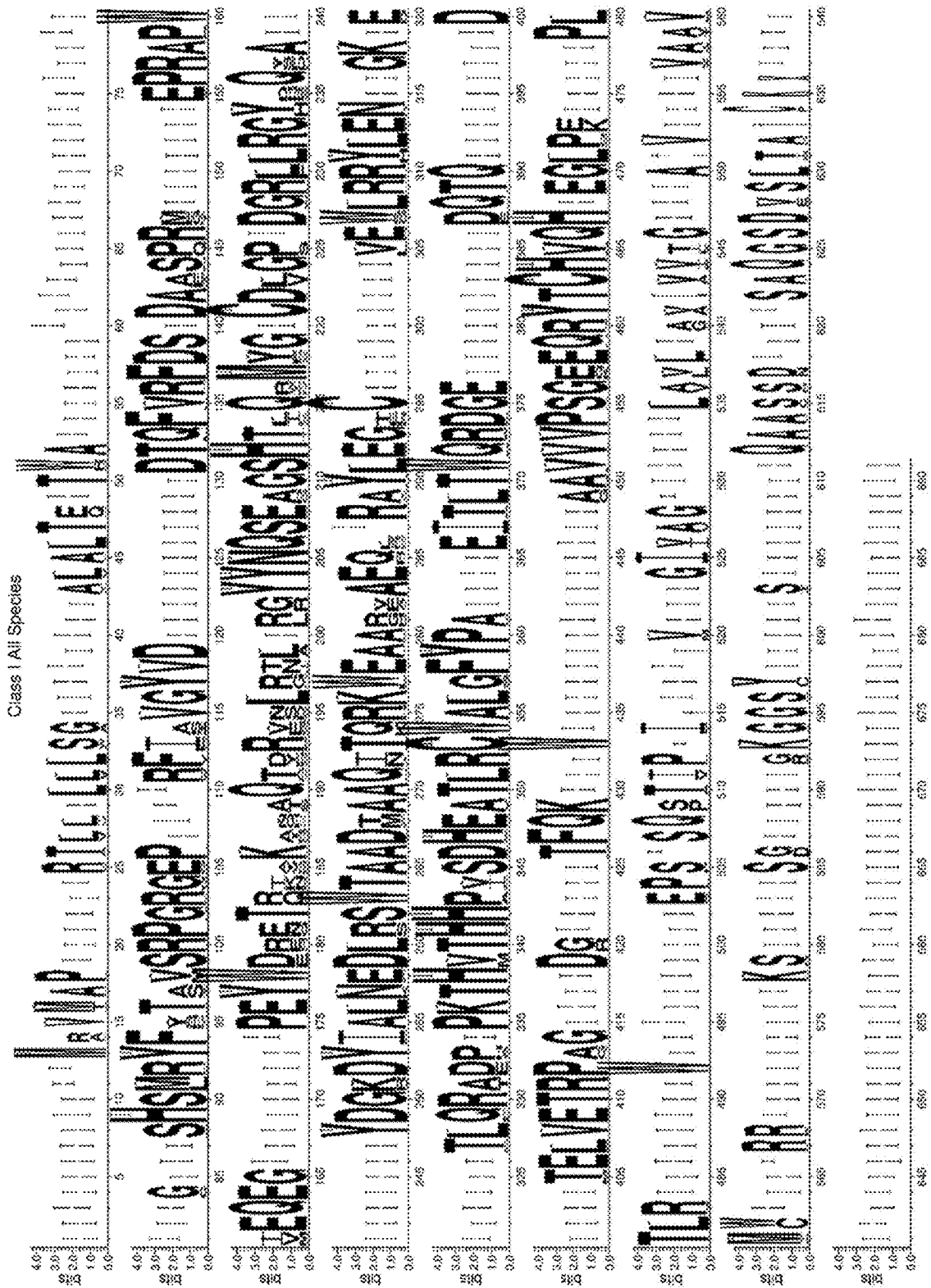
FIG. 20A displays a sequence alignment for class I MHC across a wide variety of species.
Figure 20B:
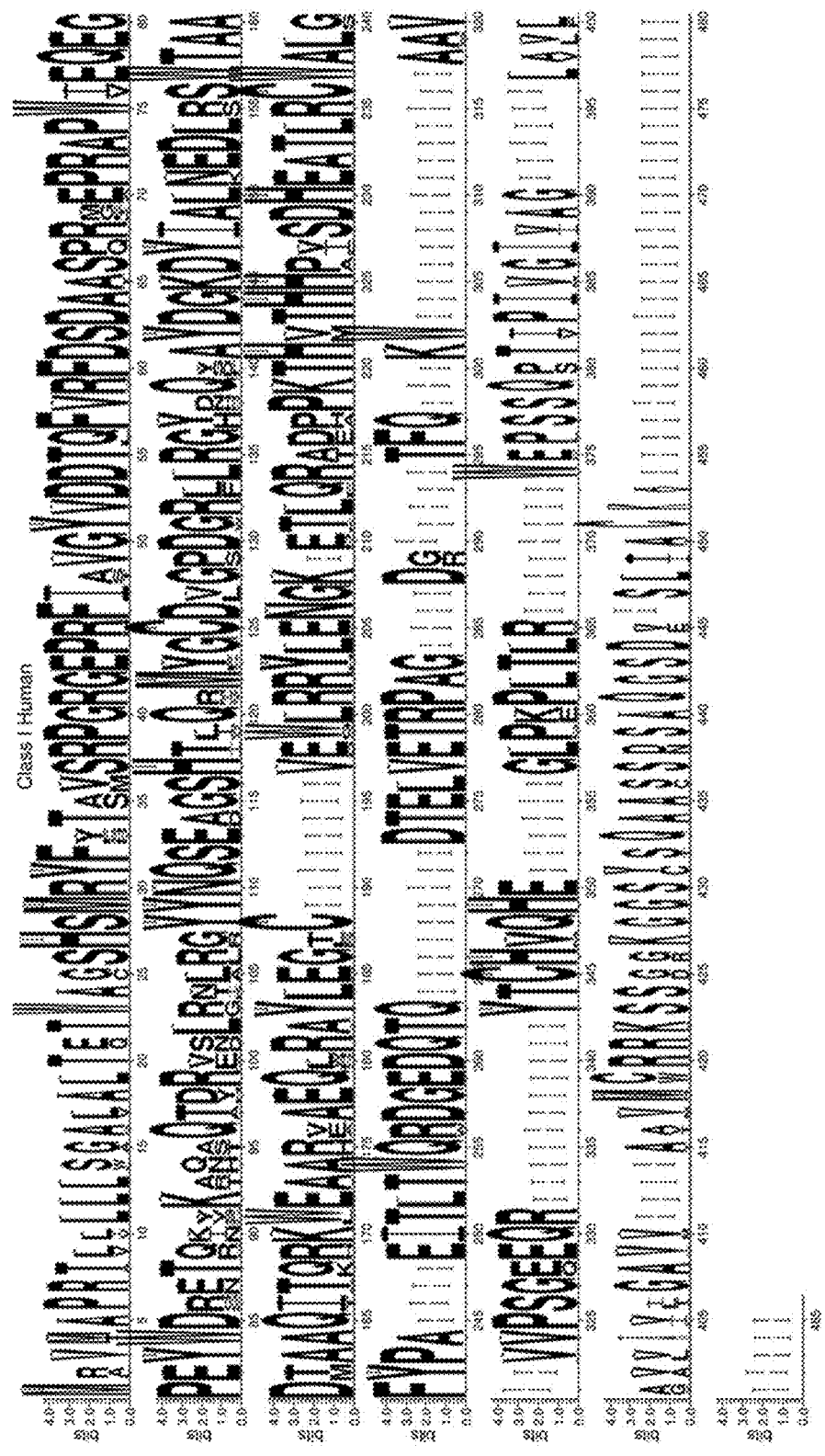
FIG. 20B displays a sequence alignment for class I MHC across humans.
Figure 20C:
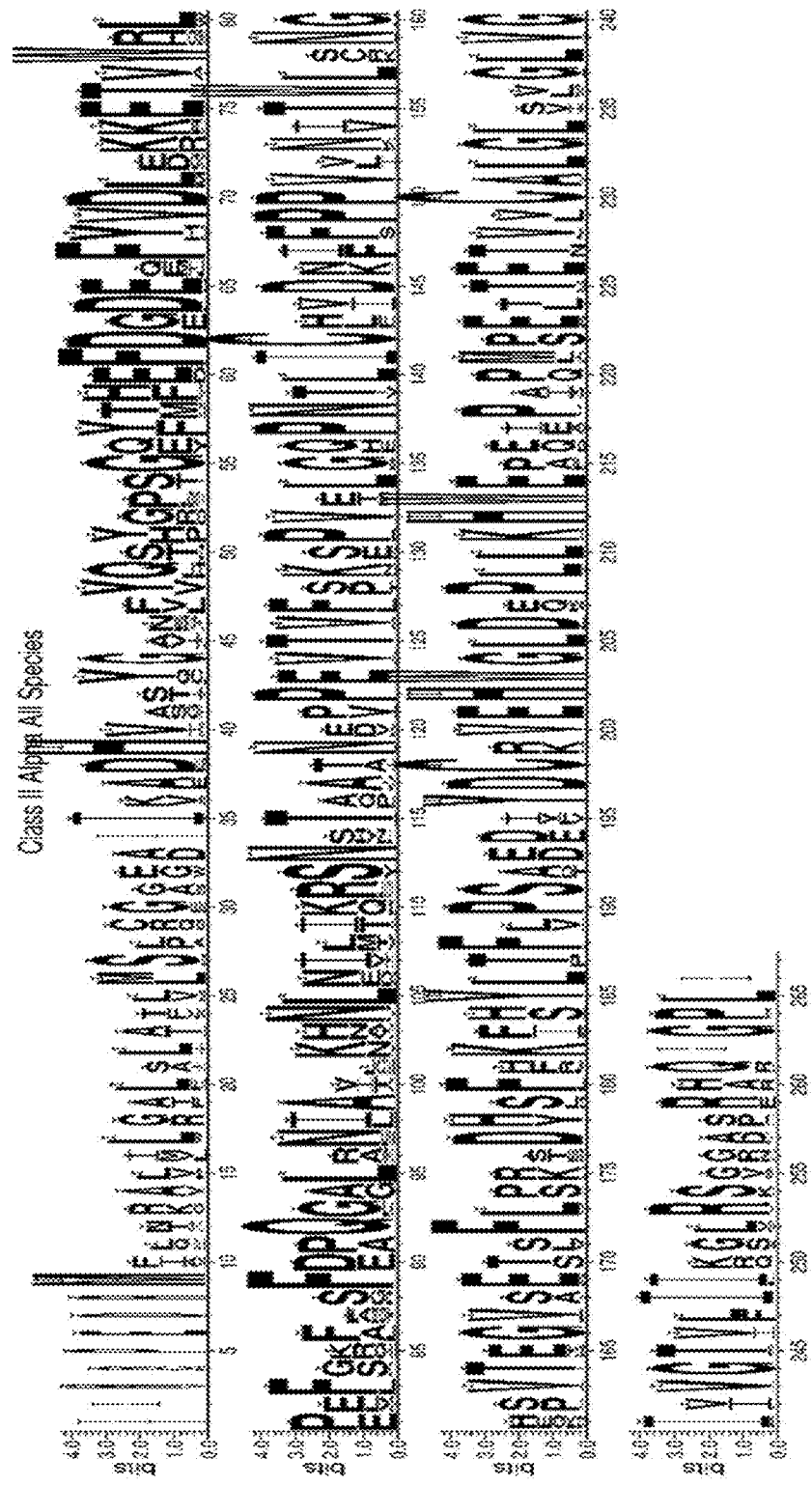
FIG. 20C displays a sequence alignment for class II alpha MHC across a wide variety of species.
Figure 20D:
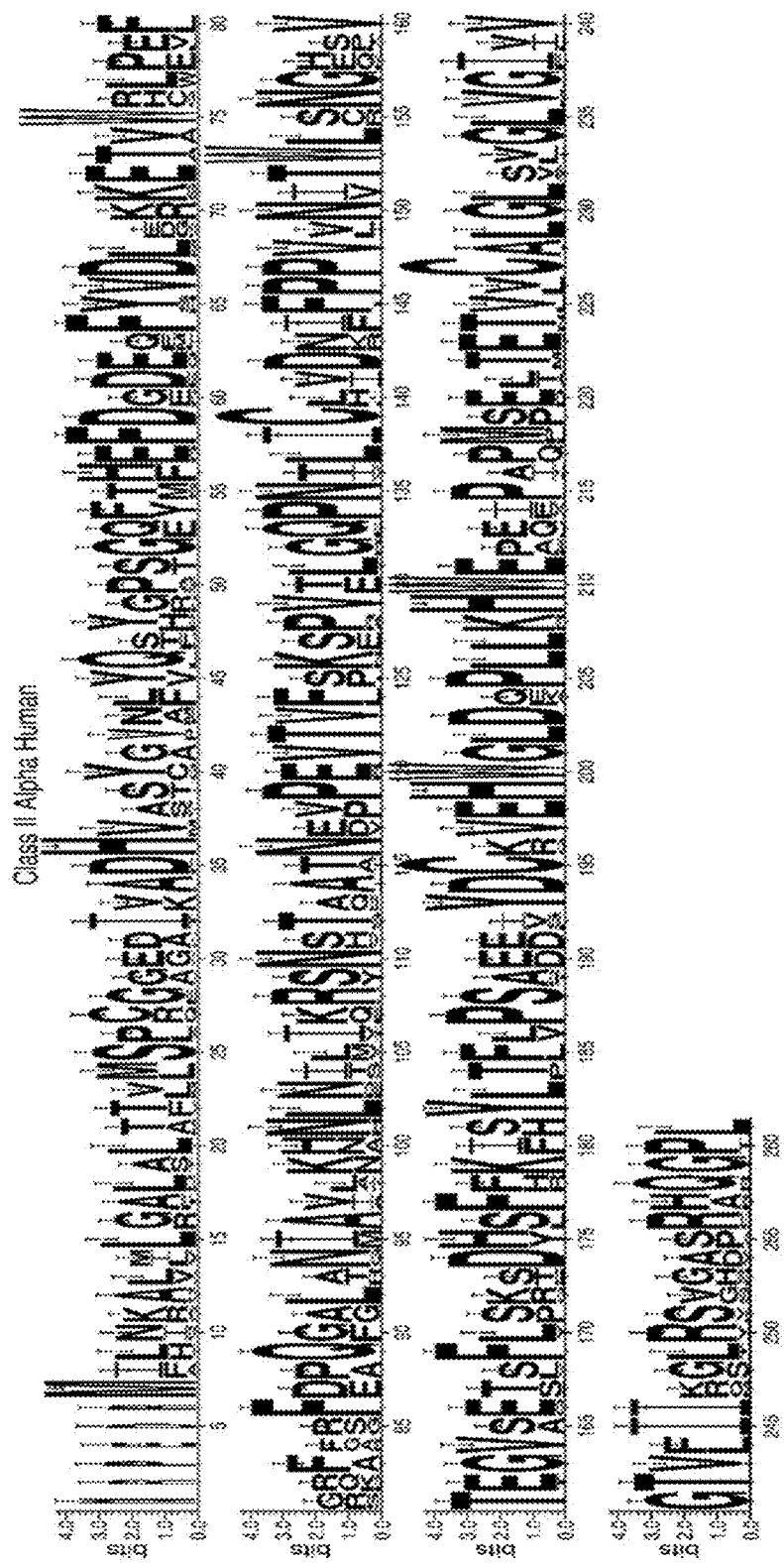
FIG. 20D displays a sequence alignment for class II alpha MHC across humans.
Figure 20E:
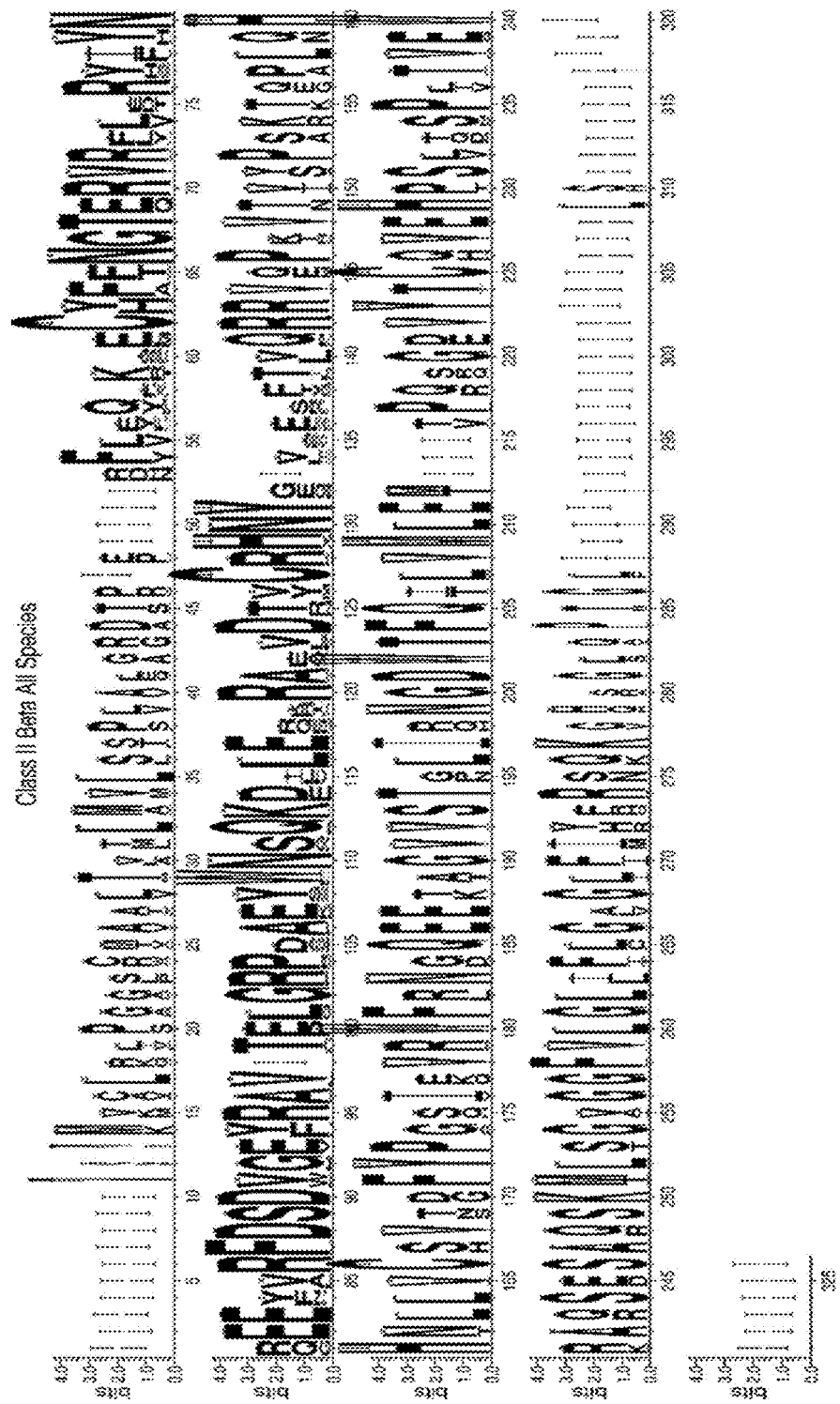
FIG. 20E displays a sequence alignment for class II beta MHC across a wide variety of species.
Figure 20F:
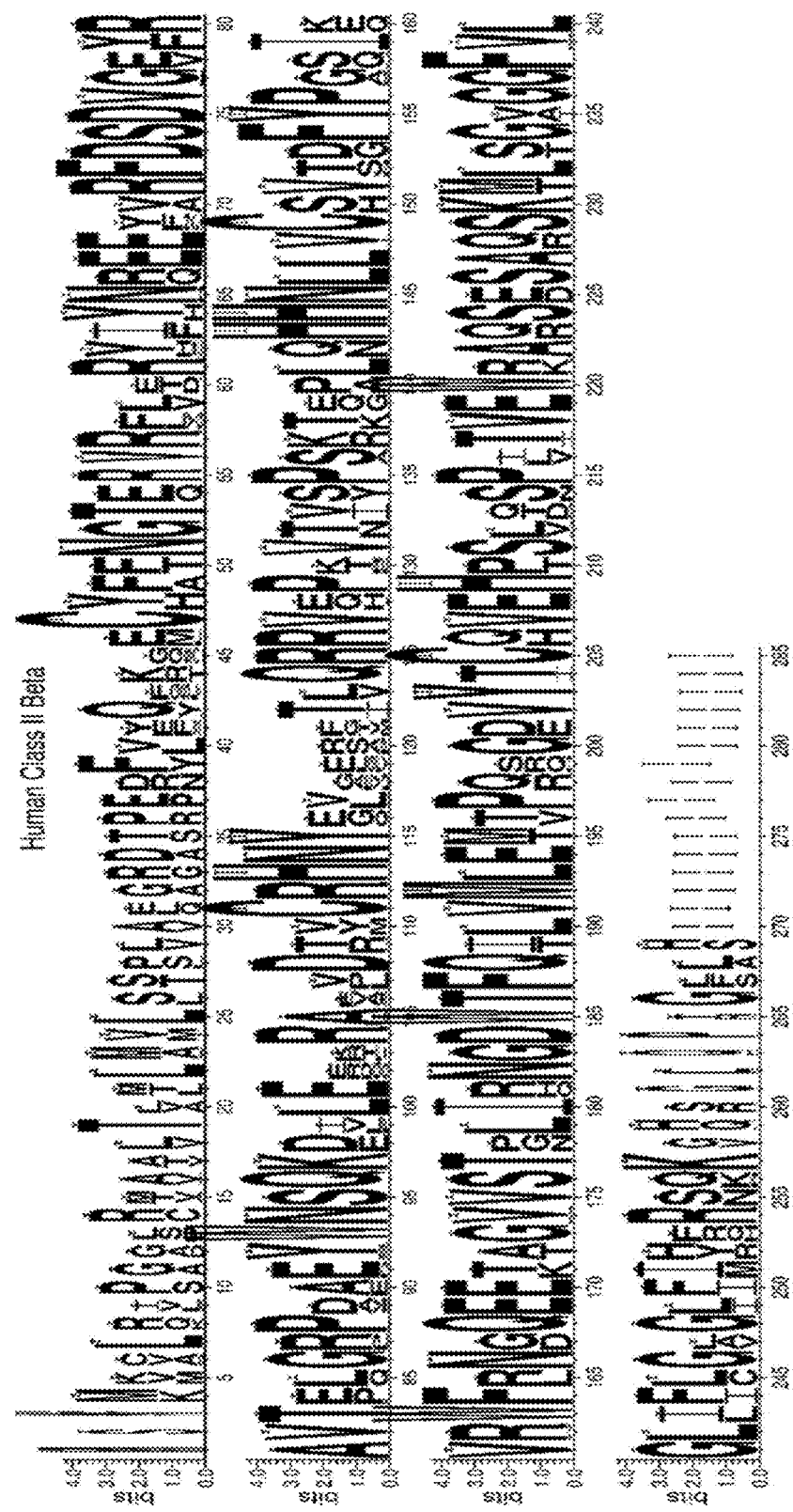
FIG. 20F displays a sequence alignment for class II beta MHC across humans.

In some embodiments, any species, variant, deletion, or modified version of each of the noted protein components (especially MHC fragment) can be employed, as long as they function as described herein. In some embodiments, this is achieved if the sequence employed is a human sequence for the component provided herein. In some embodiments, the sequence of the component can be mammalian. In some embodiments, the sequence of the component can be 80% or greater identity to a sequence provided herein or the human sequence of the component provided herein, for example, 80, 85, 90, 91, 92, 93, 94, 95, 96, 97, 98, 99, 99.9% or greater identity to the human sequence of the component (e.g., MHC, epitope, etc.). In some embodiments, the component can be a variant, as long as those sequences that are conserved between organisms are maintained. Examples of such permissible variants are described in the logo based sequence alignments provided in FIGS. 20A-20F. FIG. 20A displays a sequence alignment for class I MHC across a wide variety of species. FIG. 20B displays a sequence alignment for class I MHC across humans. FIG. 20C displays a sequence alignment for class II alpha MHC across a wide variety of species. FIG. 20D displays a sequence alignment for class II alpha MHC across humans. FIG. 20E displays a sequence alignment for class II beta MHC across a wide variety of species. FIG. 20F displays a sequence alignment for class II beta MHC across humans. With this information, one of skill in the art will appreciate those sections of the protein that are conserved and thus important for function, and those sections that are not conserved and thus can be varied.

The images in FIGS. 20A-20F are sequence logos, which are graphical representations of an amino acid or nucleic acid multiple sequence alignment. The logo is a sequence of stacks of letters, one stack for each position in the amino acid sequence alignment. The overall height of the stack indicates the sequence conservation at that position, while the height of symbols within the stack indicates the relative frequency of each amino or nucleic acid at that position. Similar to a stacked bar graph, where the one-letter code of the amino acid is used instead of a colored bar. The width of the stack is proportional to the fraction of missing sequences at that position. It is noted that many of the MHC molecules do not contain full sequences. Thinner letters mean that some sequences are missing information for that region. In these depictions, the width of the letters shouldn't matter overly. In some embodiments, the guidance is focused on those sections from parts that have deeper sequencing coverage.

REFERENCES

All references are incorporated by reference in their entireties.

Shankar an, V. et al. IFNgamma and lymphocytes prevent primary tumour development and shape tumour immunogenicity. Nature 410, 1107-1111, doi:10.1038/35074122 (2001).

Lollini, P. L., Cavallo, F., Nanni, P. & Forni, G. Vaccines for tumour prevention. Nature reviews. Cancer 6, 204-216, doi:10.1038/nrc1815 (2006).

Leach, D. R., Krummel, M. F. & Allison, J. P. Enhancement of antitumor immunity by CTLA-4 blockade. Science 271, 1734-1736 (1996).

Dong, H. et al. Tumor-associated B7-H1 promotes T-cell apoptosis: a potential mechanism of immune evasion. Nature medicine 8, 793-800, doi:10.1038/nm730 (2002).

Yee, C. et al. Adoptive T cell therapy using antigen-specific CD8+ T cell clones for the treatment of patients with metastatic melanoma: in vivo persistence, migration, and antitumor effect of transferred T cells. Proceedings of the National Academy of Sciences of the United States of America 99, 16168-16173, doi:10.1073/pnas.242600099 (2002).

Davis, M. M. & Bjorkman, P. J. T-cell antigen receptor genes and T-cell recognition. Nature 334, 395-402, doi:10.1038/334395a0 (1988).

Weiss, A. & Littman, D. R. Signal transduction by lymphocyte antigen receptors. Cell 76, 263-274 (1994).

Bethune, M. T. & Joglekar, A. V. Personalized T cell-mediated cancer immunotherapy: progress and challenges. Curr Opin Biotechnol 48, 142-152, doi:10.1016/j.copbio.2017.03.024 (2017).

Woodsworth, D. J., Castellarin, M. & Holt, R. A. Sequence analysis of T-cell repertoires in health and disease. Genome Med 5, 98, doi:10.1186/gm502 (2013).

Buchholz, V. R., Schumacher, T. N. & Busch, D. H. T Cell Fate at the Single-Cell Level. Annual review of immunology 34, 65-92, doi:10.1146/annurev-immunol-032414-112014 (2016).

Klenerman, P., Cerundolo, V. & Dunbar, P. R. Tracking T cells with tetramers: new tales from new tools. Nature reviews. Immunology 2, 263-272, doi:10.1038/nri777 (2002).

Castle, J. C. et al. Exploiting the mutanome for tumor vaccination. Cancer research 72, 1081-1091, doi:10.1158/0008-5472.CAN-11-3722 (2012).

Boon, T. & van der Bruggen, P. Human tumor antigens recognized by T lymphocytes. The Journal of experimental medicine 183, 725-729 (1996).

Matsushita, H. et al. Cancer exome analysis reveals a T-cell-dependent mechanism of cancer immunoediting. Nature 482, 400-404, doi:10.1038/nature10755 (2012).

Gee, M. H. et al. Antigen Identification for Orphan T Cell Receptors Expressed on Tumor-Infiltrating Lymphocytes. Cell 172, 549-563 e516, doi:10.1016/j.cell.2017.11.043 (2018).

Birnbaum, M. E. et al. Deconstructing the Peptide-MHC Specificity of T Cell Recognition. Cell 157, 1073-1087, doi:10.1016/j.cell.2014.03.047 (2014).

Yu, Y. Y., Netuschil, N., Lybarger, L., Connolly, J. M. & Hansen, T. H. Cutting edge: single-chain trimers of MHC class I molecules form stable structures that potently stimulate antigen-specific T cells and B cells. Journal of immunology 168, 3145-3149 (2002).

Morgan, R. A. et al. Cancer regression in patients after transfer of genetically engineered lymphocytes. Science 314, 126-129 (2006).

Joglekar, A. V. et al. T cell receptors for the HIV KK10 epitope from patients with differential immunologic control are functionally indistinguishable. Proceedings of the National Academy of Sciences of the United States of America 115, 1877-1882, doi:10.1073/pnas.1718659115 (2018).

Bennett, M. S., Joseph, A., Ng, H. L., Goldstein, H. & Yang, O. O. Fine-tuning of T-cell receptor avidity to increase HIV epitope variant recognition by cytotoxic T lymphocytes. Aids 24, 2619-2628, doi:10.1097/QAD.0b013e32833f7b22 (2010).

Sahin, U. et al. Personalized RNA mutanome vaccines mobilize poly-specific therapeutic immunity against cancer. Nature 547, 222-226, doi:10.1038/nature23003 (2017).

Li, H. & Durbin, R. Fast and accurate short read alignment with Burrows-Wheeler transform. Bioinformatics 25, 1754-1760, doi:10.1093/bioinformatics/btp324 (2009).

Vita, R. et al. The immune epitope database (IEDB) 3.0. Nucleic acids research 43, D405-412, doi:10.1093/nar/gku938 (2015).

Yokomaku, Y. et al. Impaired processing and presentation of cytotoxic-T-lymphocyte (CTL) epitopes are major escape mechanisms from CTL immune pressure in human immunodeficiency virus type 1 infection. Journal of virology 78, 1324-1332 (2004).

Dorrell, L. et al. Distinct recognition of non-clade B human immunodeficiency virus type 1 epitopes by cytotoxic T lymphocytes generated from donors infected in Africa. Journal of virology 73, 1708-1714 (1999).

Peakman, M. et al. T cell clones generated from patients with type 1 diabetes using interleukin-2 proliferate to human islet antigens. Autoimmunity 17, 31-39 (1994).

Tang, Q. & Bluestone, J. A. The Foxp3+ regulatory T cell: a jack of all trades, master of regulation. Nature immunology 9, 239-244, doi:10.1038/ni1572 (2008).

Garcia, K. C. et al. Structural basis of plasticity in T cell receptor recognition of a self peptide-MHC antigen. Science 279, 1166-1172 (1998).

Taguchi, T. et al. Detection of individual mouse splenic T cells producing IFN-gamma and IL-5 using the enzyme-linked immunospot (ELISPOT) assay. Journal of immunological methods 128, 65-73 (1990).

Suwandi, J. S., Nikolic, T. & Roep, B. O. Translating Mechanism of Regulatory Action of Tolerogenic Dendritic Cells to Monitoring Endpoints in Clinical Trials. Frontiers in immunology 8, 1598, doi:10.3389/fimmu.2017.01598 (2017).

Bentzen, A. K. & Hadrup, S. R. Evolution of MHC-based technologies used for detection of antigen-responsive T cells. Cancer immunology, immunotherapy: CII 66, 657-666, doi:10.1007/s00262-017-1971-5 (2017).

Tran, E. et al. Cancer immunotherapy based on mutation-specific CD4+ T cells in a patient with epithelial cancer. Science 344, 641-645, doi:10.1126/science.1251102 (2014).

Bassani-Sternberg, M. et al. Direct identification of clinically relevant neoepitopes presented on native human melanoma tissue by mass spectrometry. Nature communications 7, 13404, doi:10.1038/ncomms13404 (2016).

Roep B O (2003) The role of T-cells in the pathogenesis of Type 1 diabetes: from cause to cure. Diabetologia 46(3): 305-321.

Sharma G & Holt R A (2014) T-cell epitope discovery technologies. Human immunology 75(6):514-519.

Bentzen A K & Hadrup S R (2017) Evolution of MHC-based technologies used for detection of antigen-responsive T cells. Cancer immunology, immunotherapy: CII 66(5): 657-666.

Pike K A, Hui C, & Krawczyk C M (2016) Detecting Secreted Analytes from Immune Cells: An Overview of Technologies. Methods in molecular biology 1458:111-124.

Nepom G T, et al. (2002) HLA class II tetramers: tools for direct analysis of antigen-specific CD4+ T cells. Arthritis and rheumatism 46(1):5-12.

Arif S, et al. (2004) Autoreactive T cell responses show proinflammatory polarization in diabetes but a regulatory phenotype in health. The Journal of clinical investigation 113(3):451-463.

Van Lummel M, et al. (2012) Type 1 diabetes-associated HLA-DQ8 transdimer accommodates a unique peptide repertoire. The Journal of biological chemistry 287(12): 9514-9524.

Kracht M J, et al. (2017) Autoimmunity against a defective ribosomal insulin gene product in type 1 diabetes. Nature medicine 23(4):501-507.

Beringer D X, et al. (2015) T cell receptor reversed polarity recognition of a self-antigen major histocompatibility complex. Nature immunology 16(11):1153-1161.

Alhadj Ali M, et al. (2017) Metabolic and immune effects of immunotherapy with proinsulin peptide in human new-onset type 1 diabetes. Science translational medicine 9(402).

LENGTHY TABLES

The patent contains a lengthy table section. A copy of the table is available in electronic form from the USPTO web site (https://seqdata.uspto.gov/?pageRequest=docDetail&DocID=US12221465B2). An electronic copy of the table will also be available from the USPTO upon request and payment of the fee set forth in 37 CFR 1.19(b)(3).

SEQUENCE LISTING (12195 sequences)

SEQ ID NO: 1 - protein, 9 aa, Homo sapiens
AAGIGILTV

SEQ ID NO: 2 - protein, 10 aa, Trypanosoma cruzi
AASTLLYATV

SEQ ID NO: 3 - protein, 10 aa, Homo sapiens
ACDPHSGHFV

SEQ ID NO: 4 - protein, 10 aa, Hepatitis C virus
ADLMGYIPLV

SEQ ID NO: 5 - protein, 9 aa, Homo sapiens
AIIDPLIYA

SEQ ID NO: 6 - protein, 9 aa, Human immunodeficiency virus type 1
AIIRILQQL

SEQ ID NO: 7 - protein, 9 aa, Homo sapiens
AIISGDSPV

SEQ ID NO: 8 - protein, 9 aa, Hepatitis C virus
AILHTPGCV

SEQ ID NO: 9 - protein, 9 aa, Influenza A virus
AIMDKNIIL

SEQ ID NO: 10 - protein, 9 aa, Influenza A virus
AIMDKNIML

SEQ ID NO: 11 - protein, 9 aa, H5N1 subtype
AIMDKNITL

SEQ ID NO: 12 - protein, 9 aa, H5N1 subtype
AIMDKTIIL

SEQ ID NO: 13 - protein, 9 aa, H5N1 subtype
AIMDKVIIL

SEQ ID NO: 14 - protein, 9 aa, Influenza A virus
AIMEKNIIL

SEQ ID NO: 15 - protein, 9 aa, Influenza A virus
AIMEKNIML

SEQ ID NO: 16 - protein, 9 aa, Human papillomavirus type 1a
AITEVECFL

SEQ ID NO: 17 - protein, 9 aa, Hepatitis C virus
ALAHGVRAL

SEQ ID NO: 18 - protein, 9 aa, Homo sapiens
ALAPSTMKI

SEQ ID NO: 19 - protein, 9 aa, Chlamydia pneumoniae
ALAYGIDKV

SEQ ID NO: 20 - protein, 9 aa, Vaccinia virus
ALDEKLFLI

SEQ ID NO: 21 - protein, 10 aa, Homo sapiens
ALDGGNKHFL

SEQ ID NO: 22 - protein, 10 aa, Mycobacterium tuberculosis
ALEAFAIAVA

SEQ ID NO: 23 - protein, 9 aa, human herpesvirus 1
ALFFFDIDL

SEQ ID NO: 24 - protein, 10 aa, Human betaherpesvirus 5
ALFFFDIDLL

SEQ ID NO: 25 - protein, 9 aa, Homo sapiens
ALFGALFLA

SEQ ID NO: 26 - protein, 9 aa, Vaccinia virus Copenhagen
ALFYKDGKL

SEQ ID NO: 27 - protein, 9 aa, Mycobacterium tuberculosis
ALGGGATGV

SEQ ID NO: 28 - protein, 9 aa, Homo sapiens
ALLAGSEYL

SEQ ID NO: 29 - protein, 9 aa, herpes simplex virus 7
ALLEDPVGT

SEQ ID NO: 30 - protein, 9 aa, Homo sapiens
ALMDKSLHV

SEQ ID NO: 31 - protein, 9 aa, Hepatitis B virus
ALMPLYACI

SEQ ID NO: 32 - protein, 9 aa, Homo sapiens
ALNSKDAAL

SEQ ID NO: 33 - protein, 9 aa, SARS coronavirus
ALNTLVKQL

SEQ ID NO: 34 - protein, 9 aa, SARS coronavirus
ALNTPKDHI

SEQ ID NO: 35 - protein, 9 aa, Lymphocytic choriomeningitis virus
ALPHIIDEV

SEQ ID NO: 36 - protein, 9 aa, Homo sapiens
ALREEEEGV

SEQ ID NO: 37 - protein, 9 aa, Hepatitis C virus
ALRGMGLNA

SEQ ID NO: 38 - protein, 10 aa, Hepatitis C virus
ALRGMGVNAV

SEQ ID NO: 39 - protein, 9 aa, Dengue virus type 2
ALSELPETL

SEQ ID NO: 40 - protein, 9 aa, Trypanosoma cruzi
ALSLAAVLV

SEQ ID NO: 41 - protein, 10 aa, Trypanosoma cruzi
ALSLAAVLVV

SEQ ID NO: 42 - protein, 9 aa, Hepatitis C virus
ALSTGLIHL

SEQ ID NO: 43 - protein, 12 aa, Homo sapiens
ALWDIETGQQTV

SEQ ID NO: 44 - protein, 9 aa, Homo sapiens
ALWGFFPVL

SEQ ID NO: 45 - protein, 9 aa, Hepatitis C virus
ALYDVVSKL

SEQ ID NO: 46 - protein, 9 aa, Hepatitis C virus
ALYDVVTKL

SEQ ID NO: 47 - protein, 9 aa, Yellow fever virus
ALYEKKLAL

SEQ ID NO: 48 - protein, 9 aa, Mycobacterium tuberculosis
AMASTEGNV

SEQ ID NO: 49 - protein, 9 aa, H5N1 subtype
AMDSNTLEL

SEQ ID NO: 50 - protein, 9 aa, Homo sapiens
AMLDLLKSV

SEQ ID NO: 51 - protein, 10 aa, Homo sapiens
AMLGTHTMEV

SEQ ID NO: 52 - protein, 9 aa, Yellow fever virus
AMLHWSLIL

SEQ ID NO: 53 - protein, 9 aa, Vaccinia virus
AMLNGLIYV

SEQ ID NO: 54 - protein, 9 aa, Homo sapiens
AMVGAVLTA

SEQ ID NO: 55 - protein, 9 aa, Mycobacterium tuberculosis
AQLLTEFAI

SEQ ID NO: 56 - protein, 9 aa, Plasmodium falciparum
ASKNKEKAL

SEQ ID NO: 57 - protein, 9 aa, Artificial Sequence
  Recombinant seqeuence
ALSDHHIYL

SEQ ID NO: 58 - protein, 9 aa, Hepatitis C virus
ATDALMTGF

SEQ ID NO: 59 - protein, 9 aa, Hepatitis C virus
ATDALMTGY

SEQ ID NO: 60 - protein, 9 aa, West Nile virus
ATWAENIQV

SEQ ID NO: 61 - protein, 9 aa, Mycobacterium tuberculosis
AVAGAAILV

SEQ ID NO: 62 - protein, 10 aa, Human gammaherpesvirus 4
AVFDRKSDAK

SEQ ID NO: 63 - protein, 9 aa, Hepatitis C virus
CINGCVWTV

SEQ ID NO: 64 - protein, 9 aa, Hepatitis C virus
CINGVCWTA

SEQ ID NO: 65 - protein, 9 aa, Hepatitis C virus
CINGVCWTV

SEQ ID NO: 66 - protein, 9 aa, Hepatitis C virus
CINGVWCTV

SEQ ID NO: 67 - protein, 9 aa, Human gammaherpesvirus 4
CLAGLLTMV

SEQ ID NO: 68 - protein, 9 aa, Hepatitis B virus
CLFKDWEEL

SEQ ID NO: 69 - protein, 9 aa, Human gammaherpesvirus 4
CLGGLITMV

SEQ ID NO: 70 - protein, 9 aa, Human gammaherpesvirus 4
CLGGLLTMV

SEQ ID NO: 71 - protein, 9 aa, Human polyomavirus 1
CLLPKMDSV

SEQ ID NO: 72 - protein, 10 aa, Macaca mulatta
CLLPKMDSVV

SEQ ID NO: 73 - protein, 9 aa, H5N1 subtype
CLPACVYGL

SEQ ID NO: 74 - protein, 9 aa, Vaccinia virus
CLTEYILWV

SEQ ID NO: 75 - protein, 9 aa, Triticum aestivum
CQNGACWTS

SEQ ID NO: 76 - protein, 9 aa, Influenza A virus
CVNGSCFTV

SEQ ID NO: 77 - protein, 9 aa, Hepatitis C virus
CVNGVCWTV

SEQ ID NO: 78 - protein, 11 aa, Human betaherpesvirus 5
CYVLEETSVML

SEQ ID NO: 79 - protein, 9 aa, human herpesvirus 1
DIYRIFAEL

SEQ ID NO: 80 - protein, 9 aa, Hepatitis C virus
DLCGSVFLV

SEQ ID NO: 81 - protein, 10 aa, Plasmodium falciparum
DLDEPEQFRL

SEQ ID NO: 82 - protein, 9 aa, Homo sapiens
DLERKVESL

SEQ ID NO: 83 - protein, 10 aa, Hepatitis C virus
DLIAQPIRLL

SEQ ID NO: 84 - protein, 9 aa, Plasmodium falciparum
DLLEEGNTL

SEQ ID NO: 85 - protein, 9 aa, Hepatitis C virus
DLMGYIPAV

SEQ ID NO: 86 - protein, 9 aa, Hepatitis C virus
DLMGYIPLV

SEQ ID NO: 87 - protein, 9 aa, Measles virus
DLSLRRFMV

SEQ ID NO: 88 - protein, 9 aa, Mycobacterium tuberculosis
DMWEHAFYL

SEQ ID NO: 89 - protein, 10 aa, Mycobacterium tuberculosis
DMWEHAFYLQ

SEQ ID NO: 90 - protein, 9 aa, Human gammaherpesvirus 8
DNLMWYELS

SEQ ID NO: 91 - protein, 10 aa, Human gammaherpesvirus 4
DTPLIPLTIF

SEQ ID NO: 92 - protein, 9 aa, Trypanosoma cruzi
DVSRPTAVV

SEQ ID NO: 93 - protein, 10 aa, Homo sapiens
EAAGIGILTV

SEQ ID NO: 94 - protein, 10 aa, Homo sapiens
ELAGIGILTV

SEQ ID NO: 95 - protein, 9 aa, Hepatitis C virus
ELIEANLLW

SEQ ID NO: 96 - protein, 9 aa, Trypanosoma cruzi
ELIEANLLW

SEQ ID NO: 97 - protein, 9 aa, Hepatitis B virus
ELMTLATWV

SEQ ID NO: 98 - protein, 9 aa, Vaccinia virus
EMKYALINL

SEQ ID NO: 99 - protein, 9 aa, Vaccinia virus
EMQLKIDKL

SEQ ID NO: 100 - protein, 11 aa, Human betaherpesvirus 5
ESLKTFEQVTE

SEQ ID NO: 101 - protein, 9 aa, Hepatitis C virus
ETFWAKHMW

SEQ ID NO: 102 - protein, 11 aa, Hepatitis C virus
EVIAPAVQTNW

SEQ ID NO: 103 - protein, 9 aa, Coxsackievirus
EVKEKHEFL

SEQ ID NO: 104 - protein, 9 aa, Human papillomavirus type 16
FAFRDLCIV

SEQ ID NO: 105 - protein, 9 aa, Trypanosoma cruzi
FANCNFTLV

SEQ ID NO: 106 - protein, 9 aa, Trypanosoma cruzi
FANHDFTLV

SEQ ID NO: 107 - protein, 9 aa, Trypanosoma cruzi
FANHKFTLV

SEQ ID NO: 108 - protein, 9 aa, Trypanosoma cruzi
FANHNFTLV

SEQ ID NO: 109 - protein, 9 aa, Trypanosoma cruzi
FANNEFTLV

SEQ ID NO: 110 - protein, 9 aa, Trypanosoma cruzi
FANNKFTLV

SEQ ID NO: 111 - protein, 9 aa, Trypanosoma cruzi
FANYKFTLV

SEQ ID NO: 112 - protein, 9 aa, Trypanosoma cruzi
FANYNFTLV

SEQ ID NO: 113 - protein, 9 aa, SARS coronavirus
FIAGLIAIV

SEQ ID NO: 114 - protein, 11 aa, Human betaherpesvirus 5
FIAGNSAYEYV

SEQ ID NO: 115 - protein, 9 aa, Vaccinia virus
FILGIIITV

SEQ ID NO: 116 - protein, 9 aa, herpes simplex virus 7
FIPENQRTV

SEQ ID NO: 117 - protein, 12 aa, Homo sapiens
FIVPLTDLRIPS

SEQ ID NO: 118 - protein, 9 aa, Mycobacterium tuberculosis
FIYAGSLSA

SEQ ID NO: 119 - protein, 9 aa, Human gammaherpesvirus 4
FLDKGTYTL

SEQ ID NO: 120 - protein, 9 aa, Homo sapiens
FLEQQNKIL

SEQ ID NO: 121 - protein, 10 aa, Homo sapiens
FLEQQNKILL

SEQ ID NO: 122 - protein, 10 aa, Homo sapiens
FLFDGSPTYV

SEQ ID NO: 123 - protein, 11 aa, Homo sapiens
FLFDGSPTYVL

SEQ ID NO: 124 - protein, 9 aa, Homo sapiens
FLFLRNFSL

SEQ ID NO: 125 - protein, 10 aa, Human immunodeficiency virus
FLGKIWPSYK

SEQ ID NO: 126 - protein, 9 aa, Homo sapiens
FLGMESCGI

SEQ ID NO: 127 - protein, 9 aa, Human polyomavirus 1
FLHCIVFNV

SEQ ID NO: 128 - protein, 9 aa, Vaccinia virus
FLHTTFIDV

SEQ ID NO: 129 - protein, 10 aa, Plasmodium falciparum
FLIFFDLFLV

SEQ ID NO: 130 - protein, 10 aa, Hepatitis C virus
FLIFFDLFLV

SEQ ID NO: 131 - protein, 9 aa, Hepatitis C virus
FLLLADARV

SEQ ID NO: 132 - protein, 9 aa, Hepatitis B virus
FLLSLGIHL

SEQ ID NO: 133 - protein, 9 aa, Hepatitis B virus
FLLTKILTI

SEQ ID NO: 134 - protein, 9 aa, Hepatitis B virus
FLLTRILTI

SEQ ID NO: 135 - protein, 10 aa, Francisella tularensis
FLMPFMHYIV

SEQ ID NO: 136 - protein, 9 aa, Vaccinia virus
FLNISWFYI

SEQ ID NO: 137 - protein, 10 aa, Hepatitis B virus
FLPADFFPSI

SEQ ID NO: 138 - protein, 10 aa, Hepatitis B virus
FLPADFFPSV

SEQ ID NO: 139 - protein, 10 aa, Hepatitis B virus
FLPNDFFPSV

SEQ ID NO: 140 - protein, 10 aa, Hepatitis B virus
FLPPDFFPSV

SEQ ID NO: 141 - protein, 10 aa, Hepatitis B virus
FLPSDFFPGV

SEQ ID NO: 142 - protein, 9 aa, Hepatitis B virus
FLPSDFFPS

SEQ ID NO: 143 - protein, 10 aa, Hepatitis B virus
FLPSDFFPSA

SEQ ID NO: 144 - protein, 10 aa, Hepatitis B virus
FLPSDFFPSI

SEQ ID NO: 145 - protein, 10 aa, Hepatitis B virus
FLPSDFFPSV

SEQ ID NO: 146 - protein, 10 aa, Hepatitis B virus
FLPSDFLPSV

SEQ ID NO: 147 - protein, 10 aa, Hepatitis B virus
FLPSDTNMGL

SEQ ID NO: 148 - protein, 10 aa, Homo sapiens
FLPSPLFFFL

SEQ ID NO: 149 - protein, 10 aa, Hepatitis B virus
FLPVDFFPSI

SEQ ID NO: 150 - protein, 10 aa, Hepatitis B virus
FLPVDFFPSV

SEQ ID NO: 151 - protein, 9 aa, Human gammaherpesvirus 4
FLRGRAYGL

SEQ ID NO: 152 - protein, 9 aa, Zaire ebolavirus
FLSFASLFL

SEQ ID NO: 153 - protein, 9 aa, Trypanosoma cruzi
FLSHDFTLV

SEQ ID NO: 154 - protein, 9 aa, Trypanosoma cruzi
FLSHNFTLV

SEQ ID NO: 155 - protein, 10 aa, Hepatitis B virus
FLPNDFFPSA

SEQ ID NO: 156 - protein, 9 aa, Vaccinia virus
FLTSVINRV

SEQ ID NO: 157 - protein, 9 aa, Human alphaherpesvirus 2
FLVDAIVRV

SEQ ID NO: 158 - protein, 10 aa, Human alphaherpesvirus 2
FLVDAIVRVA

SEQ ID NO: 159 - protein, 9 aa, Vaccinia virus
FLVIAINAM

SEQ ID NO: 160 - protein, 8 aa, Human gammaherpesvirus 4
FLYALALL

SEQ ID NO: 161 - protein, 8 aa, Human gammaherpesvirus 4
FLYALALL

SEQ ID NO: 162 - protein, 9 aa, Homo sapiens
FLYGALLLA

SEQ ID NO: 163 - protein, 9 aa, Francisella tularensis
FMPKVNFEV

SEQ ID NO: 164 - protein, 9 aa, Human gammaherpesvirus 4
FMVFLQTHI

SEQ ID NO: 165 - protein, 9 aa, Influenza A virus
FMYSDFHFI

SEQ ID NO: 166 - protein, 10 aa, Homo sapiens
FPPSPLFFFL

SEQ ID NO: 167 - protein, 9 aa, Trypanosoma cruzi
FTLVAPVSI

SEQ ID NO: 168 - protein, 9 aa, Trypanosoma cruzi
FTSAVLLLV

SEQ ID NO: 169 - protein, 9 aa, Vaccinia virus
FVDVIIIKV

SEQ ID NO: 170 - protein, 9 aa, Trypanosoma cruzi
FVDYNFSLV

SEQ ID NO: 171 - protein, 9 aa, Trypanosoma cruzi
FVDYNFTIV

SEQ ID NO: 172 - protein, 9 aa, Homo sapiens
FVFDRPLPV

SEQ ID NO: 173 - protein, 9 aa, Homo sapiens
FVFLRNFSL

SEQ ID NO: 174 - protein, 10 aa, Vaccinia virus
FVNFNSVKNL

SEQ ID NO: 175 - protein, 10 aa, Trypanosoma cruzi
FVNFNSVKNL

SEQ ID NO: 176 - protein, 9 aa, Trypanosoma cruzi
FVNHDFTVV

SEQ ID NO: 177 - protein, 9 aa, Trypanosoma cruzi
FVNYDFALV

SEQ ID NO: 178 - protein, 9 aa, Trypanosoma cruzi
FVNYDFTIV

SEQ ID NO: 179 - protein, 9 aa, Trypanosoma cruzi
FVNYDFTIV

SEQ ID NO: 180 - protein, 9 aa, Trypanosoma cruzi
FVSCDFTIV

SEQ ID NO: 181 - protein, 10 aa, Human alphaherpesvirus 2
GFLIAYQPLL

SEQ ID NO: 182 - protein, 9 aa, Plasmodium falciparum
GIAGGLALL

SEQ ID NO: 183 - protein, 9 aa, Coxsackievirus B
GIIYIIYKL

SEQ ID NO: 184 - protein, 9 aa, Influenza A virus
GILGFVFTL

SEQ ID NO: 185 - protein, 10 aa, Influenza A virus
GILGFVFTLT

SEQ ID NO: 186 - protein, 9 aa, Mycobacterium tuberculosis
GILTVSVAV

SEQ ID NO: 187 - protein, 9 aa, Human alphaherpesvirus 2
GLADTVVAC

SEQ ID NO: 188 - protein, 11 aa, Homo sapiens
GLAPPQHLIRV

SEQ ID NO: 189 - protein, 9 aa, Homo sapiens
GLATDVQTV

SEQ ID NO: 190 - protein, 9 aa, Human parvovirus B19
GLCPHCINV

SEQ ID NO: 191 - protein, 10 aa, Human parvovirus B19
GLCPHCINVG

SEQ ID NO: 192 - protein, 9 aa, Human gammaherpesvirus 4
GLCTLVAML

SEQ ID NO: 193 - protein, 9 aa, Hantaan virus
GLDCARLEI

SEQ ID NO: 194 - protein, 9 aa, Vaccinia virus
GLFDFVNFV

SEQ ID NO: 195 - protein, 10 aa, Influenza A virus
GLFGAIAGFI

SEQ ID NO: 196 - protein, 9 aa, Artificial Sequence
  UNKNOWN
GLFGGGGGV

SEQ ID NO: 197 - protein, 9 aa, Yellow fever virus
GLFGGLNWI

SEQ ID NO: 198 - protein, 9 aa, Hepatitis C virus
GLGWVGWLL

SEQ ID NO: 199 - protein, 10 aa, Mycobacterium tuberculosis
GLIDIAPHQI

SEQ ID NO: 200 - protein, 12 aa, Mycobacterium tuberculosis
GLIDIAPHQISS

SEQ ID NO: 201 - protein, 9 aa, Homo sapiens
GLIEKNIEL

SEQ ID NO: 202 - protein, 9 aa, Plasmodium falciparum
GLIMVLSFL

SEQ ID NO: 203 - protein, 9 aa, Influenza A virus
GLISLILQI

SEQ ID NO: 204 - protein, 10 aa, Hepatitis C virus
GLLGCIITSL

SEQ ID NO: 205 - protein, 14 aa, Artificial Sequence
  Unknown
GLLGFVFTLMCMGL

SEQ ID NO: 206 - protein, 9 aa, Plasmodium falciparum
GLLGNVSTV

SEQ ID NO: 207 - protein, 9 aa, Homo sapiens
GLLGTLVQL

SEQ ID NO: 208 - protein, 9 aa, Mycobacterium tuberculosis
GLLHHAPSL

SEQ ID NO: 209 - protein, 10 aa, Trypanosoma cruzi
GLLLLGLWGT

SEQ ID NO: 210 - protein, 9 aa, Human T-lymphotropic virus 1
GLLPFHSTL

SEQ ID NO: 211 - protein, 10 aa, Trypanosoma cruzi
GLLPSLLLLL

SEQ ID NO: 212 - protein, 9 aa, Homo sapiens
GLLRVISGV

SEQ ID NO: 213 - protein, 10 aa, Trypanosoma cruzi
GLMNNAFEWI

SEQ ID NO: 214 - protein, 9 aa, SARS coronavirus TJF
GLMWLSYFV

SEQ ID NO: 215 - protein, 9 aa, Vaccinia virus
GLNDYLHSV

SEQ ID NO: 216 - protein, 9 aa, Mycobacterium tuberculosis
GLPVEYLQV

SEQ ID NO: 217 - protein, 9 aa, Hepatitis C virus
GLQDCTMLV

SEQ ID NO: 218 - protein, 10 aa, Hepatitis B virus
GLSAMSTTDL

SEQ ID NO: 219 - protein, 9 aa, human herpesvirus 1
GLSISGNLL

SEQ ID NO: 220 - protein, 10 aa, Hepatitis B virus
GLSPTVWLSA

SEQ ID NO: 221 - protein, 10 aa, Hepatitis B virus
GLSPTVWLSV

SEQ ID NO: 222 - protein, 9 aa, Hepatitis B virus
GLSRYVARL

SEQ ID NO: 223 - protein, 10 aa, Plasmodium vivax
GLVILLVLAL

SEQ ID NO: 224 - protein, 9 aa, Yellow fever virus
GLYGNGILV

SEQ ID NO: 225 - protein, 9 aa, Homo sapiens
GLYPGLIWL

SEQ ID NO: 226 - protein, 9 aa, Homo sapiens
GLYSGVTTV

SEQ ID NO: 227 - protein, 9 aa, H5N1 subtype
GMDPRMCSL

SEQ ID NO: 228 - protein, 9 aa, Mycobacterium tuberculosis
GMGPSLIGL

SEQ ID NO: 229 - protein, 9 aa, H5N1 subtype
GMLGFVFTL

SEQ ID NO: 230 - protein, 9 aa, SARS coronavirus
GMSRIGMEV

SEQ ID NO: 231 - protein, 9 aa, Human papillomavirus type 16
GTLGIVCPI

SEQ ID NO: 232 - protein, 9 aa, Hepatitis C virus
GVRVLEDGV

SEQ ID NO: 233 - protein, 10 aa, Homo sapiens
GVYDGEEHSV

SEQ ID NO: 234 - protein, 8 aa, Plasmodium falciparum
HLGNKYLV

SEQ ID NO: 235 - protein, 9 aa, Plasmodium falciparum
HLGNVKYLV

SEQ ID NO: 236 - protein, 9 aa, Measles virus
HLMIDRPYV

SEQ ID NO: 237 - protein, 9 aa, Hepatitis B virus
HLSLRGLFV

SEQ ID NO: 238 - protein, 9 aa, Hepatitis B virus
HLSLRGLPV

SEQ ID NO: 239 - protein, 9 aa, Hepatitis C virus
HMWNFISGI

SEQ ID NO: 240 - protein, 9 aa, Human papillomavirus type 44
HNNGICWGN

SEQ ID NO: 241 - protein, 11 aa, Human gammaherpesvirus 4
HPVGEADYFEY

SEQ ID NO: 242 - protein, 9 aa, Vaccinia virus
HVDGKILFV

SEQ ID NO: 243 - protein, 9 aa, Trypanosoma cruzi
IAGGVMAVV

SEQ ID NO: 244 - protein, 10 aa, Human betaherpesvirus 5
IAGNSAYEYV

SEQ ID NO: 245 - protein, 9 aa, Trypanosoma cruzi
IANYNFTLV

SEQ ID NO: 246 - protein, 10 aa, Vaccinia virus
IIIPFIAYFV

SEQ ID NO: 247 - protein, 10 aa, Trypanosoma cruzi
IILNGSLLTL

SEQ ID NO: 248 - protein, 9 aa, Yellow fever virus
IIMDEAHFL

SEQ ID NO: 249 - protein, 9 aa, Hepatitis C virus
ILAGYGAGV

SEQ ID NO: 250 - protein, 9 aa, Vaccinia virus
ILDDNLYKV

SEQ ID NO: 251 - protein, 9 aa, Human betaherpesvirus 5
ILDEERDKV

SEQ ID NO: 252 - protein, 9 aa, Homo sapiens
ILDKKVEKV

SEQ ID NO: 253 - protein, 9 aa, Homo sapiens
ILDQKINEV

SEQ ID NO: 254 - protein, 9 aa, Hepatitis C virus
ILDSFDPLV

SEQ ID NO: 255 - protein, 9 aa, Homo sapiens
ILDSVGIEA

SEQ ID NO: 256 - protein, 10 aa, Influenza A virus
ILGFVFTLTV

SEQ ID NO: 257 - protein, 8 aa, Hepatitis C virus
ILHTPGCV

SEQ ID NO: 258 - protein, 9 aa, Human immunodeficiency virus
ILKEPVHGV

SEQ ID NO: 259 - protein, 9 aa, Homo sapiens
ILLAELEQL

SEQ ID NO: 260 - protein, 9 aa, Hantaan orthohantavirus
ILLGSLSDL

SEQ ID NO: 261 - protein, 9 aa, SARS coronavirus
ILLNKHIDA

SEQ ID NO: 262 - protein, 9 aa, West Nile virus
ILLWEIPDV

SEQ ID NO: 263 - protein, 9 aa, Homo sapiens
ILMEHIHKL

SEQ ID NO: 264 - protein, 10 aa, Vaccinia virus
ILMIFISSFL

SEQ ID NO: 265 - protein, 10 aa, Coxsackievirus
ILMNDQEVGV

SEQ ID NO: 266 - protein, 9 aa, JC virus
ILMWEAVTL

SEQ ID NO: 267 - protein, 9 aa, Human respiratory syncytial virus
ILNNPKASL

SEQ ID NO: 268 - protein, 9 aa, SARS coronavirus
ILPDPLKPT

SEQ ID NO: 269 - protein, 10 aa, Measles virus
ILPGQDLQYV

SEQ ID NO: 270 - protein, 9 aa, Hantaan virus
ILPSKSLEV

SEQ ID NO: 271 - protein, 9 aa, Homo sapiens
ILQDGRIFI

SEQ ID NO: 272 - protein, 9 aa, Hantaan virus
ILQDMRNTI

SEQ ID NO: 273 - protein, 9 aa, Vaccinia virus
ILSDENYLL

SEQ ID NO: 274 - protein, 9 aa, Hepatitis B virus
ILSPFLPLL

SEQ ID NO: 275 - protein, 10 aa, Plasmodium falciparum
ILSVSSFLFV

SEQ ID NO: 276 - protein, 9 aa, Homo sapiens
ILTDITKGV

SEQ ID NO: 277 - protein, 9 aa, Homo sapiens
ILTVILGVL

SEQ ID NO: 278 - protein, 10 aa, H1N1 swine influenza virus
IMDKNIILKA

SEQ ID NO: 279 - protein, 9 aa, Homo sapiens
IMDQVPFSV

SEQ ID NO: 280 - protein, 9 aa, Hantaan virus
IMELATAGI

SEQ ID NO: 281 - protein, 9 aa, Artificial Sequence
  unknown
IMIGHLVGV

SEQ ID NO: 282 - protein, 9 aa, Homo sapiens
IMIGVLVGV

SEQ ID NO: 283 - protein, 8 aa, Homo sapiens
MLEALERV

SEQ ID NO: 284 - protein, 9 aa, Artificial Sequence
  unknown
IMMGVLVGV

SEQ ID NO: 285 - protein, 9 aa, Francisella tularensis
IMSSFEFQV

SEQ ID NO: 286 - protein, 9 aa, Plasmodium falciparum
IMVLSFLFL

SEQ ID NO: 287 - protein, 9 aa, Mycobacterium tuberculosis
IMYNYPAML

SEQ ID NO: 288 - protein, 9 aa, Homo sapiens
ITDQVPFSV

SEQ ID NO: 289 - protein, 9 aa, Vaccinia virus
IVIEAIHTV

SEQ ID NO: 290 - protein, 9 aa, Hepatitis B virus
IVSPFIPLL

SEQ ID NO: 291 - protein, 12 aa, Influenza A virus
KGILGFVFTLTV

SEQ ID NO: 292 - protein, 9 aa, Vaccinia virus
KIDYYIPYV

SEQ ID NO: 293 - protein, 9 aa, Vaccinia virus
KIEDLINQL

SEQ ID NO: 294 - protein, 9 aa, Homo sapiens
KIFGSLAFL

SEQ ID NO: 295 - protein, 9 aa, Plasmodium falciparum
KILSVFFLA

SEQ ID NO: 296 - protein, 9 aa, Vaccinia virus
KINIFMAFL

SEQ ID NO: 297 - protein, 9 aa, Dengue virus type 2
KLAEAIFKL

SEQ ID NO: 298 - protein, 9 aa, Mycobacterium tuberculosis
KLAGGVAVI

SEQ ID NO: 299 - protein, 9 aa, Human polyomavirus 1
KLCTFSFLI

SEQ ID NO: 300 - protein, 9 aa, Hepatitis D virus
KLEDENPWL

SEQ ID NO: 301 - protein, 9 aa, Hepatitis D virus
KLEDLERDL

SEQ ID NO: 302 - protein, 9 aa, Trypanosoma cruzi
KLFPEVIDL

SEQ ID NO: 303 - protein, 9 aa, Vaccinia virus
KLFTHDIML

SEQ ID NO: 304 - protein, 9 aa, Influenza B virus
KLGEFYNQM

SEQ ID NO: 305 - protein, 9 aa, Francisella tularensis
KLGGYVSFV

SEQ ID NO: 306 - protein, 10 aa, Homo sapiens
KLHEEEIQEL

SEQ ID NO: 307 - protein, 9 aa, Mycobacterium tuberculosis
KLIANNTRV

SEQ ID NO: 308 - protein, 9 aa, Homo sapiens
KLKDVLLQV

SEQ ID NO: 309 - protein, 9 aa, Plasmodium falciparum
KLKEFIPKV

SEQ ID NO: 310 - protein, 9 aa, Plasmodium falciparum
KLKKIKNSI

SEQ ID NO: 311 - protein, 9 aa, Plasmodium falciparum
KLKKIKNSL

SEQ ID NO: 312 - protein, 10 aa, Homo sapiens
KLLEGEEERL

SEQ ID NO: 313 - protein, 10 aa, Homo sapiens
KLLEGEESRI

SEQ ID NO: 314 - protein, 9 aa, Francisella tularensis
KLLGQINLV

SEQ ID NO: 315 - protein, 9 aa, Francisella tularensis
KLLPEGYWV

SEQ ID NO: 316 - protein, 10 aa, SARS coronavirus
KLPDDFMGCV

SEQ ID NO: 317 - protein, 9 aa, Human papillomavirus type 18
KLPDLCTEL

SEQ ID NO: 318 - protein, 9 aa, Human papillomavirus type 16
KLPQLCTEL

SEQ ID NO: 319 - protein, 9 aa, Plasmodium falciparum
KLQEQQSDL

SEQ ID NO: 320 - protein, 9 aa, Mycobacterium tuberculosis
KLQERLAKL

SEQ ID NO: 321 - protein, 10 aa, Plasmodium falciparum
KLRKPKHKKL

SEQ ID NO: 322 - protein, 9 aa, H5N1 subtype
KLSDYEGRL

SEQ ID NO: 323 - protein, 10 aa, Hepatitis C virus
KLSGLGINAV

SEQ ID NO: 324 - protein, 10 aa, Hepatitis C virus
KLSGLGLNAV

SEQ ID NO: 325 - protein, 10 aa, Hepatitis C virus
KLSSLGLNAV

SEQ ID NO: 326 - protein, 10 aa, Hepatitis C virus
KLVALGINAV

SEQ ID NO: 327 - protein, 10 aa, Hepatitis C virus
KLVALGVNAV

SEQ ID NO: 328 - protein, 10 aa, Hepatitis C virus
KLVAMGINAV

SEQ ID NO: 329 - protein, 9 aa, Mycobacterium tuberculosis
KLVANNTRL

SEQ ID NO: 330 - protein, 10 aa, Hepatitis C virus
KLVSLGVNAV

SEQ ID NO: 331 - protein, 10 aa, Hepatitis C virus
KLVVLGINAV

SEQ ID NO: 332 - protein, 9 aa, Measles virus
KLWCRHFCV

SEQ ID NO: 333 - protein, 9 aa, Measles virus
KLWESPQEI

SEQ ID NO: 334 - protein, 9 aa, Trypanosoma cruzi
KLYCSYEVA

SEQ ID NO: 335 - protein, 10 aa, Influenza A virus
KLYQNPTTYI

SEQ ID NO: 336 - protein, 9 aa, Human respiratory syncytial virus
KMLKEMGEV

SEQ ID NO: 337 - protein, 9 aa, Vaccinia virus
KMTLFKSIL

SEQ ID NO: 338 - protein, 9 aa, Homo sapiens
KMVELVHFL

SEQ ID NO: 339 - protein, 9 aa, Plasmodium falciparum
KNKEKALII

SEQ ID NO: 340 - protein, 10 aa, Trypanosoma cruzi
KTWADEYLCV

SEQ ID NO: 341 - protein, 9 aa, Homo sapiens
KTWGQYWQV

SEQ ID NO: 342 - protein, 9 aa, Artificial Sequence
  unknown
KVAEIVHFL

SEQ ID NO: 343 - protein, 9 aa, Homo sapiens
KVAELVHFL

SEQ ID NO: 344 - protein, 9 aa, Artificial Sequence
  unknown
KVAELVWFL

SEQ ID NO: 345 - protein, 9 aa, Vaccinia virus
KVDDTFYYV

SEQ ID NO: 346 - protein, 9 aa, Homo sapiens
KVLEYVIKV

SEQ ID NO: 347 - protein, 10 aa, Hepatitis C virus
KVLHKRTLGL

SEQ ID NO: 348 - protein, 9 aa, Trypanosoma cruzi
KVVSLVILA

SEQ ID NO: 349 - protein, 9 aa, Homo sapiens
KYPENFFLL

SEQ ID NO: 350 - protein, 9 aa, SARS coronavirus
LALLLLDRL

SEQ ID NO: 351 - protein, 9 aa, Mycobacterium tuberculosis
LFAAFPSFA

SEQ ID NO: 352 - protein, 8 aa, Human T-lymphotropic virus 1
LFGYPVYV

SEQ ID NO: 353 - protein, 9 aa, Homo sapiens
LGYGFVNYI

SEQ ID NO: 354 - protein, 9 aa, Homo sapiens
LGYGFVNYV

SEQ ID NO: 355 - protein, 9 aa, H5N1 subtype
LIFLARSAL

SEQ ID NO: 356 - protein, 9 aa, Vaccinia virus
LIQEIVHEV

SEQ ID NO: 357 - protein, 9 aa, SARS coronavirus
LITGRLQSL

SEQ ID NO: 358 - protein, 10 aa, Hepatitis C virus
LLALLSCLTV

SEQ ID NO: 359 - protein, 10 aa, Mycobacterium tuberculosis
LLAVLTAAPL

SEQ ID NO: 360 - protein, 9 aa, Hepatitis B virus
LLCLIFLLV

SEQ ID NO: 361 - protein, 9 aa, Hepatitis C virus
LLCPAGHAV

SEQ ID NO: 362 - protein, 9 aa, Mycobacterium tuberculosis
LLDAHIPQL

SEQ ID NO: 363 - protein, 9 aa, Mycobacterium tuberculosis
LLDEGKQSL

SEQ ID NO: 364 - protein, 9 aa, Homo sapiens
LLDEPTNHL

SEQ ID NO: 365 - protein, 10 aa, Human gammaherpesvirus 4
LLDFVRFMGV

SEQ ID NO: 366 - protein, 9 aa, Homo sapiens
LLDVPTAAV

SEQ ID NO: 367 - protein, 8 aa, Homo sapiens
LLDVTAAV

SEQ ID NO: 368 - protein, 10 aa, Hepatitis B virus
LLDYQGMLPV

SEQ ID NO: 369 - protein, 9 aa, Human T-lymphotropic virus 1
LLFEEYTNI

SEQ ID NO: 370 - protein, 9 aa, Human T-lymphotropic virus 1
LLFGHPVYV

SEQ ID NO: 371 - protein, 9 aa, Human T-lymphotropic virus 1
LLFGYAVYV

SEQ ID NO: 372 - protein, 9 aa, Human T-lymphotropic virus 1
LLFGYPRYV

SEQ ID NO: 373 - protein, 9 aa, Human T-lymphotropic virus 1
LLFGYPVAV

SEQ ID NO: 374 - protein, 9 aa, Human T-lymphotropic virus 1
LLFGYPVYV

SEQ ID NO: 375 - protein, 10 aa, Hepatitis C virus
LLFNILGGWV

SEQ ID NO: 376 - protein, 9 aa, Hepatitis C virus
LLGCIITSL

SEQ ID NO: 377 - protein, 10 aa, Trypanosoma cruzi
LLGLWGLATA

SEQ ID NO: 378 - protein, 10 aa, Trypanosoma cruzi
LLGLWGLTGL

SEQ ID NO: 379 - protein, 10 aa, Trypanosoma cruzi
LLGLWGTAAL

SEQ ID NO: 380 - protein, 10 aa, Trypanosoma cruzi
LLGLWVFAAL

SEQ ID NO: 381 - protein, 9 aa, Homo sapiens
LLGRNSFEV

SEQ ID NO: 382 - protein, 9 aa, Human parvovirus B19
LLHTDFEQV

SEQ ID NO: 383 - protein, 10 aa, Human parvovirus B19
LLHTDFEQVM

SEQ ID NO: 384 - protein, 9 aa, SARS coronavirus
LLLDRLNQL

SEQ ID NO: 385 - protein, 10 aa, Homo sapiens
LLLDVPTAAV

SEQ ID NO: 386 - protein, 12 aa, Homo sapiens
LLLDVPTAAVQA

SEQ ID NO: 387 - protein, 10 aa, Homo sapiens
LLLDVTPLSL

SEQ ID NO: 388 - protein, 10 aa, Trypanosoma cruzi
LLLGLWGTAA

SEQ ID NO: 389 - protein, 9 aa, Human polyomavirus 1
LLLIWFRPV

SEQ ID NO: 390 - protein, 9 aa, Trypanosoma cruzi
LLLLGLWGL

SEQ ID NO: 391 - protein, 9 aa, Plasmodium falciparum
LLMDCSGSI

SEQ ID NO: 392 - protein, 9 aa, Human papillomavirus type 16
LLMGTLGIV

SEQ ID NO: 393 - protein, 9 aa, Human polyomavirus 1
LLMWEAVTV

SEQ ID NO: 394 - protein, 9 aa, Human immunodeficiency virus type 1
LLNATDIAV

SEQ ID NO: 395 - protein, 9 aa, Human gammaherpesvirus 8
LLNGWRWRL

SEQ ID NO: 396 - protein, 9 aa, herpes simplex virus 7
LLPPELSET

SEQ ID NO: 397 - protein, 9 aa, Hepatitis C virus
LLPRRGPRL

SEQ ID NO: 398 - protein, 10 aa, Homo sapiens
LLQDSVDFSL

SEQ ID NO: 399 - protein, 9 aa, Homo sapiens
LLSAEPVPA

SEQ ID NO: 400 - protein, 10 aa, Mycobacterium tuberculosis
LLSVLAAVGL

SEQ ID NO: 401 - protein, 9 aa, Influenza A virus
LLTEVETYV

SEQ ID NO: 402 - protein, 9 aa, Trypanosoma cruzi
LLTTSGVSA

SEQ ID NO: 403 - protein, 9 aa, Human gammaherpesvirus 4
LLVDLLWLL

SEQ ID NO: 404 - protein, 9 aa, Human herpesvirus 4
LLWAARPRL

SEQ ID NO: 405 - protein, 9 aa, Measles virus
LLWSYAMGV

SEQ ID NO: 406 - protein, 8 aa, Human herpesvirus 4
LLWTLVVL

SEQ ID NO: 407 - protein, 9 aa, Human gammaherpesvirus 4
LLWTLVVLL

SEQ ID NO: 408 - protein, 9 aa, Human T-lymphotropic virus 2
LLYGYPVYV

SEQ ID NO: 409 - protein, 10 aa, Trypanosoma cruzi
LLYSDDALHL

SEQ ID NO: 410 - protein, 9 aa, herpes simplex virus 7
LMHAPAFET

SEQ ID NO: 411 - protein, 9 aa, Measles virus
LMIDRPYVL

SEQ ID NO: 412 - protein, 9 aa, Mycobacterium tuberculosis
LMIGTAAAV

SEQ ID NO: 413 - protein, 9 aa, Human herpesvirus 4
LMIIPLINV

SEQ ID NO: 414 - protein, 9 aa, Homo sapiens
LMLGEFLKL

SEQ ID NO: 415 - protein, 9 aa, Macaca mulatta
LMLIWYRPV

SEQ ID NO: 416 - protein, 9 aa, Human betaherpesvirus 5
LMNGQQIFL

SEQ ID NO: 417 - protein, 9 aa, Trypanosoma cruzi
LMNNAFEWI

SEQ ID NO: 418 - protein, 10 aa, Trypanosoma cruzi
LMNNAFEWIV

SEQ ID NO: 419 - protein, 9 aa, Francisella tularensis
LMWDNVGLV

SEQ ID NO: 420 - protein, 9 aa, Human gammaherpesvirus 8
LMWYELSKI

SEQ ID NO: 421 - protein, 10 aa, Human gammaherpesvirus 8
LMWYELSKIN

SEQ ID NO: 422 - protein, 9 aa, Vaccinia virus
LNIMNKLNI

SEQ ID NO: 423 - protein, 9 aa, Dengue virus type 1
LPAIVREAI

SEQ ID NO: 424 - protein, 9 aa, SARS coronavirus
LQLPQGTTL

SEQ ID NO: 425 - protein, 9 aa, Human papillomavirus type 16
LQTTIHDII

SEQ ID NO: 426 - protein, 10 aa, Homo sapiens
LVALLACLTV

SEQ ID NO: 427 - protein, 10 aa, Homo sapiens
LVALLVCLTV

SEQ ID NO: 428 - protein, 11 aa, Hepatitis C virus
LSPYYKRYISW

SEQ ID NO: 429 - protein, 9 aa, Human immunodeficiency virus type 1
LVGPTPVNI

SEQ ID NO: 430 - protein, 9 aa, Hepatitis C virus
LVMAQLLRI

SEQ ID NO: 431 - protein, 9 aa, Mycobacterium tuberculosis
LVVADLSFI

SEQ ID NO: 432 - protein, 9 aa, Homo sapiens
MIMQGGFSV

SEQ ID NO: 433 - protein, 9 aa, Plasmodium falciparum
MINAYLDKL

SEQ ID NO: 434 - protein, 9 aa, Hepatitis C virus
MLAAQMFIV

SEQ ID NO: 435 - protein, 9 aa, Human papillomavirus type 16
MLDLQPETT

SEQ ID NO: 436 - protein, 9 aa, Homo sapiens
MLGTHTMEV

SEQ ID NO: 437 - protein, 9 aa, Dengue virus
MLLALIAVL

SEQ ID NO: 438 - protein, 9 aa, Homo sapiens
MLLAVLYCL

SEQ ID NO: 439 - protein, 9 aa, Human betaherpesvirus 5
MLNIPSINV

SEQ ID NO: 440 - protein, 10 aa, Vaccinia virus
MLVSQALNSV

SEQ ID NO: 441 - protein, 9 aa, Saccharomyces cerevisiae
MLWGYLQYV

SEQ ID NO: 442 - protein, 9 aa, Homo sapiens
MMAKEEELV

SEQ ID NO: 443 - protein, 9 aa, Dermatophagoides pteronyssinus
MMIEEYPYV

SEQ ID NO: 444 - protein, 9 aa, Vaccinia virus
MMLVPLITV

SEQ ID NO: 445 - protein, 9 aa, Hepatitis C virus
MMMNWSPTT

SEQ ID NO: 446 - protein, 10 aa, Plasmodium falciparum
MMRKLAILSV

SEQ ID NO: 447 - protein, 9 aa, Vaccinia virus
MPAYIRNTL

SEQ ID NO: 448 - protein, 9 aa, Plasmodium falciparum
MPNDPNRNV

SEQ ID NO: 449 - protein, 9 aa, Plasmodium falciparum
MPNNPNRNV

SEQ ID NO: 450 - protein, 9 aa, Mycobacterium tuberculosis
MTYAAPLFV

SEQ ID NO: 451 - protein, 9 aa, Homo sapiens
MVDGTLLLL

SEQ ID NO: 452 - protein, 9 aa, H5N1 subtype
MVDGTLLLL

SEQ ID NO: 453 - protein, 9 aa, Human gammaherpesvirus 8
MWYELSKIN

SEQ ID NO: 454 - protein, 9 aa, Hepatitis C virus
NEGCGWAGW

SEQ ID NO: 455 - protein, 9 aa, Homo sapiens
NEGCGWAGW

SEQ ID NO: 456 - protein, 9 aa, Vaccinia virus
NEGCGWAGW

SEQ ID NO: 457 - protein, 9 aa, Mycobacterium tuberculosis
NLLVTGFDT

SEQ ID NO: 458 - protein, 9 aa, Human gammaherpesvirus 8
NLMWYELSK

SEQ ID NO: 459 - protein, 10 aa, Human gammaherpesvirus 8
NLMWYELSKI

SEQ ID NO: 460 - protein, 9 aa, Plasmodium falciparum
NLNDNAIHL

SEQ ID NO: 461 - protein, 9 aa, SARS coronavirus
NLNESLIDL

SEQ ID NO: 462 - protein, 9 aa, Hepatitis C virus
NLPGCSFSI

SEQ ID NO: 463 - protein, 9 aa, Human betaherpesvirus 5
NLVPIVATV

SEQ ID NO: 464 - protein, 9 aa, Human betaherpesvirus 5
NLVPMVATV

SEQ ID NO: 465 - protein, 9 aa, Homo sapiens
NLYPFVKTV

SEQ ID NO: 466 - protein, 9 aa, Influenza A virus
NMLSTVLGV

SEQ ID NO: 467 - protein, 10 aa, Plasmodium falciparum
NMPNDPNRNV

SEQ ID NO: 468 - protein, 9 aa, Homo sapiens
NQFPGFKEV

SEQ ID NO: 469 - protein, 9 aa, Human T-lymphotropic virus 1
PLFGYPVYV

SEQ ID NO: 470 - protein, 11 aa, Human betaherpesvirus 5
PSQEPMSIYVY

SEQ ID NO: 471 - protein, 9 aa, Human gammaherpesvirus 4
PYLFWLAAI

SEQ ID NO: 472 - protein, 9 aa, Dengue virus
QEGAMHTAL

SEQ ID NO: 473 - protein, 9 aa, Hepatitis B virus
QLDPARDVL

SEQ ID NO: 474 - protein, 9 aa, Homo sapiens
QLFNHTMFI

SEQ ID NO: 475 - protein, 9 aa, Human T-lymphotropic virus 1
QLGAFLTNV

SEQ ID NO: 476 - protein, 10 aa, Triticum aestivum
QLIPCMDVVL

SEQ ID NO: 477 - protein, 9 aa, Human respiratory syncytial virus
QLLSSSKYT

SEQ ID NO: 478 - protein, 9 aa, Homo sapiens
QLMAEKLQL

SEQ ID NO: 479 - protein, 9 aa, Measles virus
QLPEATFMV

SEQ ID NO: 480 - protein, 10 aa, Hepatitis C virus
QLRRHIDLLV

SEQ ID NO: 481 - protein, 10 aa, Trypanosoma cruzi
QMDYSNGLFV

SEQ ID NO: 482 - protein, 9 aa, Hepatitis C virus
QMWKCLIRL

SEQ ID NO: 483 - protein, 9 aa, Human betaherpesvirus 5
QMWQARLTV

SEQ ID NO: 484 - protein, 9 aa, Human betaherpesvirus 5
QYDPVAALF

SEQ ID NO: 485 - protein, 8 aa, Human gammaherpesvirus 4
RAKFKQLL

SEQ ID NO: 486 - protein, 9 aa, Homo sapiens
RALAETSYV

SEQ ID NO: 487 - protein, 9 aa, Human gammaherpesvirus 8
RDNLMWYEL

SEQ ID NO: 488 - protein, 10 aa, Human immunodeficiency virus
RGPGRAFVTI

SEQ ID NO: 489 - protein, 9 aa, human herpesvirus 1
RIFAELEGV

SEQ ID NO: 490 - protein, 9 aa, Homo sapiens
RLAVYIDKV

SEQ ID NO: 491 - protein, 9 aa, Homo sapiens
RLAVYIDRV

SEQ ID NO: 492 - protein, 10 aa, West Nile virus
RLDDDGNFQL

SEQ ID NO: 493 - protein, 9 aa, Measles virus
RLERKWLDV

SEQ ID NO: 494 - protein, 9 aa, herpes simplex virus 7
RLGAVILFV

SEQ ID NO: 495 - protein, 9 aa, Francisella tularensis
RLIGHISTL

SEQ ID NO: 496 - protein, 9 aa, H5N1 subtype
RLIQNSITI

SEQ ID NO: 497 - protein, 10 aa, Hepatitis C virus
RLIVFPDLGV

SEQ ID NO: 498 - protein, 10 aa, Hepatitis C virus
RLLLLGLLLL

SEQ ID NO: 499 - protein, 10 aa, Trypanosoma cruzi
RLLPSLLLLL

SEQ ID NO: 500 - protein, 9 aa, human herpesvirus 1
RLLQTGIHV

SEQ ID NO: 501 - protein, 9 aa, Trypanosoma cruzi
RLLSPTTIV

SEQ ID NO: 502 - protein, 9 aa, Homo sapiens
RLMKQDFSV

SEQ ID NO: 503 - protein, 9 aa, SARS coronavirus
RLNEVAKNL

SEQ ID NO: 504 - protein, 9 aa, Homo sapiens
RLNKVISEL

SEQ ID NO: 505 - protein, 9 aa, SARS coronavirus
RLNQLESKV

SEQ ID NO: 506 - protein, 9 aa, Mycobacterium tuberculosis
RLPLVLPAV

SEQ ID NO: 507 - protein, 10 aa, Measles virus
RLSDNGYYTV

SEQ ID NO: 508 - protein, 11 aa, Human betaherpesvirus 5
RLTVSGLAWTR

SEQ ID NO: 509 - protein, 9 aa, Hepatitis C virus
RLWHYPCTI

SEQ ID NO: 510 - protein, 9 aa, Hepatitis C virus
RLWHYPCTV

SEQ ID NO: 511 - protein, 9 aa, Vaccinia virus
RLYDYFTRV

SEQ ID NO: 512 - protein, 9 aa, Homo sapiens
RMFPNAPYL

SEQ ID NO: 513 - protein, 9 aa, Influenza A virus
RMGAVTTEV

SEQ ID NO: 514 - protein, 9 aa, Homo sapiens
RMLPHAPGV

SEQ ID NO: 515 - protein, 9 aa, Measles virus
RMSKGVFKV

SEQ ID NO: 516 - protein, 11 aa, Human betaherpesvirus 5
RNLVPMVATVQ

SEQ ID NO: 517 - protein, 11 aa, Human betaherpesvirus 5
RPHERNGFTVL

SEQ ID NO: 518 - protein, 10 aa, Vaccinia virus
RPMSLRSTII

SEQ ID NO: 519 - protein, 9 aa, Measles virus
RRYPDAVYL

SEQ ID NO: 520 - protein, 10 aa, Hepatitis C virus
RVLEDGVNYA

SEQ ID NO: 521 - protein, 9 aa, Homo sapiens
RVPGVAPTL

SEQ ID NO: 522 - protein, 9 aa, Vaccinia virus
RVYEALYYV

SEQ ID NO: 523 - protein, 11 aa, Hepatitis C virus
SECTTPCSGSW

SEQ ID NO: 524 - protein, 9 aa, Human T-lymphotropic virus 1
SFHSLHLLF

SEQ ID NO: 525 - protein, 9 aa, Homo sapiens
SIIGRLLEV

SEQ ID NO: 526 - protein, 9 aa, JC virus
SITEVECFL

SEQ ID NO: 527 - protein, 9 aa, SARS coronavirus
SIVAYTMSL

SEQ ID NO: 528 - protein, 10 aa, Hepatitis B virus
SIVSPFIPLL

SEQ ID NO: 529 - protein, 9 aa, human herpesvirus 1
SIYVYALPL

SEQ ID NO: 530 - protein, 10 aa, Homo sapiens
SLADTNSLAV

SEQ ID NO: 531 - protein, 9 aa, Homo sapiens
SLAGGIIGV

SEQ ID NO: 532 - protein, 10 aa, Influenza A virus
SLCPIRGWAI

SEQ ID NO: 533 - protein, 9 aa, Homo sapiens
SLDDYNHLV

SEQ ID NO: 534 - protein, 9 aa, Dermatophagoides pteronyssinus
SLDLAEQEL

SEQ ID NO: 535 - protein, 9 aa, Influenza A virus
SLENFRAYV

SEQ ID NO: 536 - protein, 9 aa, West Nile virus
SLFGGMSWI

SEQ ID NO: 537 - protein, 9 aa, West Nile virus
SLFGQRIEV

SEQ ID NO: 538 - protein, 9 aa, Vaccinia virus
SLFKNVRLL

SEQ ID NO: 539 - protein, 9 aa, Homo sapiens
SLFPGKLEV

SEQ ID NO: 540 - protein, 9 aa, Homo sapiens
SLGEQQYSV

SEQ ID NO: 541 - protein, 9 aa, Human gammaherpesvirus 4
SLGGLLTMV

SEQ ID NO: 542 - protein, 10 aa, Plasmodium vivax
SLGLVILLVL

SEQ ID NO: 543 - protein, 10 aa, Hepatitis C virus
SLHTGFLASL

SEQ ID NO: 544 - protein, 9 aa, Homo sapiens
SLIGHLQTL

SEQ ID NO: 545 - protein, 9 aa, Plasmodium falciparum
SLKKNSRSL

SEQ ID NO: 546 - protein, 11 aa, Hepatitis C virus
SLLAPGAKQNV

SEQ ID NO: 547 - protein, 10 aa, Homo sapiens
SLLGGDVVSV

SEQ ID NO: 548 - protein, 9 aa, Homo sapiens
SLLMWITQC

SEQ ID NO: 549 - protein, 9 aa, Homo sapiens
SLLMWITQV

SEQ ID NO: 550 - protein, 9 aa, Homo sapiens
SLLPAIVEL

SEQ ID NO: 551 - protein, 11 aa, Homo sapiens
SLLPPDALVGL

SEQ ID NO: 552 - protein, 11 aa, Homo sapiens
SLLPPTALVGL

SEQ ID NO: 553 - protein, 9 aa, Hepatitis C virus
SLMAFTAAV

SEQ ID NO: 554 - protein, 9 aa, Lymphocytic choriomeningitis virus
SLNQTVHSL

SEQ ID NO: 555 - protein, 9 aa, herpes simplex virus 7
SLPITVYYA

SEQ ID NO: 556 - protein, 9 aa, Homo sapiens
SLQEEIAFL

SEQ ID NO: 557 - protein, 9 aa, Human polyomavirus 1
SLQNSEFLL

SEQ ID NO: 558 - protein, 9 aa, Vaccinia virus
SLSAYIIRV

SEQ ID NO: 559 - protein, 9 aa, Homo sapiens
SLSEKTVLL

SEQ ID NO: 560 - protein, 9 aa, Trypanosoma cruzi
SLSHYFTLV

SEQ ID NO: 561 - protein, 9 aa, Vaccinia virus
SLSNLDFRL

SEQ ID NO: 562 - protein, 9 aa, Homo sapiens
SLSRFSWGA

SEQ ID NO: 563 - protein, 9 aa, West Nile virus
SLTSINVQA

SEQ ID NO: 564 - protein, 9 aa, Human gammaherpesvirus 4
SLVIVTTFV

SEQ ID NO: 565 - protein, 9 aa, West Nile virus
SLVNGVVRL

SEQ ID NO: 566 - protein, 9 aa, Homo sapiens
SLWGQPAEA

SEQ ID NO: 567 - protein, 9 aa, Mycobacterium tuberculosis
SLYFGGICV

SEQ ID NO: 568 - protein, 9 aa, Human immunodeficiency virus
SLYNTIAVL

SEQ ID NO: 569 - protein, 9 aa, HIV-1 M:B
SLYNTVATL

SEQ ID NO: 570 - protein, 9 aa, Mycobacterium tuberculosis
SMAGSSAMI

SEQ ID NO: 571 - protein, 9 aa, Vaccinia virus
SMHFYGWSL

SEQ ID NO: 572 - protein, 9 aa, Trypanosoma cruzi
SMNATLVQA

SEQ ID NO: 573 - protein, 9 aa, Hepatitis C virus
SMVGNWAKV

SEQ ID NO: 574 - protein, 10 aa, Hepatitis C virus
SMVGNWAKVL

SEQ ID NO: 575 - protein, 9 aa, Influenza A virus
SRYWAIRTR

SEQ ID NO: 576 - protein, 9 aa, Hepatitis B virus
STLPETTVV

SEQ ID NO: 577 - protein, 9 aa, Trypanosoma cruzi
SVFRENLFL

SEQ ID NO: 578 - protein, 9 aa, Homo sapiens
SVGGVFTSV

SEQ ID NO: 579 - protein, 11 aa, Human betaherpesvirus 5
SVMKRRIEEIC

SEQ ID NO: 580 - protein, 9 aa, Human gammaherpesvirus 4
SVRDRLARL

SEQ ID NO: 581 - protein, 9 aa, Homo sapiens
SVYDFFVWL

SEQ ID NO: 582 - protein, 10 aa, Hepatitis C virus
TARHTPVNSW

SEQ ID NO: 583 - protein, 10 aa, Hepatitis C virus
TGSPITYSTY

SEQ ID NO: 584 - protein, 10 aa, Human papillomavirus type 16
TIHDIILECV

SEQ ID NO: 585 - protein, 9 aa, Mycobacterium tuberculosis
TIPEALAAV

SEQ ID NO: 586 - protein, 9 aa, Human polyomavirus 1
TLACFAVYT

SEQ ID NO: 587 - protein, 10 aa, SARS coronavirus
TLACFVLAAV

SEQ ID NO: 588 - protein, 10 aa, Mycobacterium tuberculosis
TLAGKGISVV

SEQ ID NO: 589 - protein, 9 aa, West Nile virus
TLARGFPFV

SEQ ID NO: 590 - protein, 9 aa, Homo sapiens
TLDSQVMSL

SEQ ID NO: 591 - protein, 9 aa, Human gammaherpesvirus 4
TLDYKPLSV

SEQ ID NO: 592 - protein, 9 aa, Trypanosoma cruzi
TLEEFSAKL

SEQ ID NO: 593 - protein, 9 aa, Homo sapiens
TLEGFASPL

SEQ ID NO: 594 - protein, 9 aa, Human herpesvirus 4
TLFIGSHVV

SEQ ID NO: 595 - protein, 9 aa, Vaccinia virus
TLFPGDDDL

SEQ ID NO: 596 - protein, 8 aa, Human papillomavirus type 16
TLGIVCPI

SEQ ID NO: 597 - protein, 9 aa, Human papillomavirus type 16
TLGIVCPIC

SEQ ID NO: 598 - protein, 9 aa, Human T-lymphotropic virus 1
TLGQHLPTL

SEQ ID NO: 599 - protein, 9 aa, Human papillomavirus type 16
TLHEYMLDL

SEQ ID NO: 600 - protein, 9 aa, Vaccinia virus
TLKQRLTNL

SEQ ID NO: 601 - protein, 9 aa, Human rotavirus
TLLANVTAV

SEQ ID NO: 602 - protein, 9 aa, Human gammaherpesvirus 4
TLLVDLLWL

SEQ ID NO: 603 - protein, 9 aa, Trypanosoma cruzi
TLLYATVEV

SEQ ID NO: 604 - protein, 9 aa, Human adenovirus type 5
TLLYVLFEV

SEQ ID NO: 605 - protein, 9 aa, Human immunodeficiency virus
TLNAWVKVV

SEQ ID NO: 606 - protein, 9 aa, Plasmodium vivax
TLNDLETDV

SEQ ID NO: 607 - protein, 10 aa, Plasmodium falciparum
TLRKPKHKKL

SEQ ID NO: 608 - protein, 9 aa, Homo sapiens
TLWVDPYEV

SEQ ID NO: 609 - protein, 9 aa, Human betaherpesvirus 5
TMYGGISLL

SEQ ID NO: 610 - protein, 10 aa, Human betaherpesvirus 5
TPRVTGGGAM

SEQ ID NO: 611 - protein, 10 aa, Hepatitis C virus
VFFNILGGWV

SEQ ID NO: 612 - protein, 9 aa, Homo sapiens
VGYVDDTQF

SEQ ID NO: 613 - protein, 9 aa, Human polyomavirus 1
VIFDFLHCI

SEQ ID NO: 614 - protein, 9 aa, human herpesvirus 1
VIGDQYVKV

SEQ ID NO: 615 - protein, 9 aa, Human immunodeficiency virus
VIYQYMDDL

SEQ ID NO: 616 - protein, 10 aa, Hepatitis C virus
VLAALAAYCL

SEQ ID NO: 617 - protein, 9 aa, Plasmodium falciparum
VLAGLLGNV

SEQ ID NO: 618 - protein, 9 aa, Trypanosoma cruzi
VLAKDGTEV

SEQ ID NO: 619 - protein, 9 aa, Hepatitis C virus
VLCLRPVGA

SEQ ID NO: 620 - protein, 9 aa, Plasmodium falciparum
VLDKVEETV

SEQ ID NO: 621 - protein, 10 aa, Vaccinia virus
VLEDVQAAGI

SEQ ID NO: 622 - protein, 9 aa, Human betaherpesvirus 5
VLEETSVML

SEQ ID NO: 623 - protein, 10 aa, Human immunodeficiency virus
VLEWRFDSRL

SEQ ID NO: 624 - protein, 9 aa, Hepatitis B virus
VLGGCRHKL

SEQ ID NO: 625 - protein, 9 aa, human herpesvirus 1
VLGPISGHV

SEQ ID NO: 626 - protein, 9 aa, Mycobacterium tuberculosis
VLGRLDQKL

SEQ ID NO: 627 - protein, 9 aa, Hepatitis C virus
VLHKRTLGL

SEQ ID NO: 628 - protein, 10 aa, Plasmodium falciparum
VLLGGVGLVL

SEQ ID NO: 629 - protein, 9 aa, Human alphaherpesvirus 1
VLLNAPSEA

SEQ ID NO: 630 - protein, 10 aa, Human gammaherpesvirus 8
VLLNGWRWRL

SEQ ID NO: 631 - protein, 9 aa, Trypanosoma cruzi
VLLPSLFLL

SEQ ID NO: 632 - protein, 10 aa, Trypanosoma cruzi
VLLPSLFLLL

SEQ ID NO: 633 - protein, 9 aa, Influenza A virus
VLLVSLGAI

SEQ ID NO: 634 - protein, 10 aa, Mycobacterium tuberculosis
VLMGGVPGVE

SEQ ID NO: 635 - protein, 9 aa, Homo sapiens
VLMIKALEL

SEQ ID NO: 636 - protein, 9 aa, SARS coronavirus
VLNDILSRL

SEQ ID NO: 637 - protein, 9 aa, West Nile virus
VLNETTNWL

SEQ ID NO: 638 - protein, 9 aa, Dengue virus type 2
VLNPYMPSV

SEQ ID NO: 639 - protein, 9 aa, Artificial Sequence
  unknown
VLPDVFIRC

SEQ ID NO: 640 - protein, 9 aa, Vaccinia virus
VLPFDIKKL

SEQ ID NO: 641 - protein, 9 aa, Homo sapiens
VLQELNVTV

SEQ ID NO: 642 - protein, 9 aa, Human gammaherpesvirus 4
VLQWASLAV

SEQ ID NO: 643 - protein, 9 aa, Hepatitis C virus
VLSDFKTWL

SEQ ID NO: 644 - protein, 10 aa, Mycobacterium tuberculosis
VLTDGNPPEV

SEQ ID NO: 645 - protein, 9 aa, Vaccinia virus
VLYDEFVTI

SEQ ID NO: 646 - protein, 10 aa, Homo sapiens
VLYRYGSFSV

SEQ ID NO: 647 - protein, 9 aa, Human T-lymphotropic virus 1
VLYSPNVSV

SEQ ID NO: 648 - protein, 9 aa, Trypanosoma cruzi
VMACLVPAA

SEQ ID NO: 649 - protein, 9 aa, Homo sapiens
VMAPRTLIL

SEQ ID NO: 650 - protein, 9 aa, Homo sapiens
VMAPRTLVL

SEQ ID NO: 651 - protein, 9 aa, Homo sapiens
VMDSKIVQV

SEQ ID NO: 652 - protein, 10 aa, Hepatitis C virus
VMLAAQMFIV

SEQ ID NO: 653 - protein, 9 aa, Trypanosoma cruzi
VMMSCSSEA

SEQ ID NO: 654 - protein, 9 aa, Trypanosoma cruzi
VTLPTGQCL

SEQ ID NO: 655 - protein, 10 aa, Hepatitis C virus
VVFDITKWLL

SEQ ID NO: 656 - protein, 9 aa, Human polyomavirus 1
VVFEDVKGT

SEQ ID NO: 657 - protein, 9 aa, SARS coronavirus
VVFLHVTYV

SEQ ID NO: 658 - protein, 10 aa, Hepatitis C virus
VVLDSLDPMV

SEQ ID NO: 659 - protein, 10 aa, Trypanosoma cruzi
VVMACLVPAA

SEQ ID NO: 660 - protein, 9 aa, Human gammaherpesvirus 8
WATESPIYV

SEQ ID NO: 661 - protein, 9 aa, Trypanosoma cruzi
WIIKNSWTA

SEQ ID NO: 662 - protein, 9 aa, Francisella tularensis
WLGNHGFEV

SEQ ID NO: 663 - protein, 9 aa, Hepatitis C virus
WLGNIIQYA

SEQ ID NO: 664 - protein, 9 aa, Vaccinia virus
WLIGFDFDV

SEQ ID NO: 665 - protein, 9 aa, Trypanosoma cruzi
WLSDCGEAL

SEQ ID NO: 666 - protein, 9 aa, Hepatitis B virus
WLSLLVPFV

SEQ ID NO: 667 - protein, 9 aa, Hepatitis C virus
WMNRLIAFA

SEQ ID NO: 668 - protein, 10 aa, Trypanosoma cruzi
WVFPESISPV

SEQ ID NO: 669 - protein, 9 aa, Human gammaherpesvirus 8
WYELSKINP

SEQ ID NO: 670 - protein, 9 aa, Human gammaherpesvirus 8
YELSKINPT

SEQ ID NO: 671 - protein, 9 aa, Homo sapiens
YGIENEVFL

SEQ ID NO: 672 - protein, 9 aa, Vaccinia virus
YIDISDVKV

SEQ ID NO: 673 - protein, 9 aa, Homo sapiens
YIGSGDSPV

SEQ ID NO: 674 - protein, 9 aa, Homo sapiens
YIIIGDSPV

SEQ ID NO: 675 - protein, 9 aa, Homo sapiens
YIILGDSPV

SEQ ID NO: 676 - protein, 9 aa, Homo sapiens
YIISGDLPV

SEQ ID NO: 677 - protein, 9 aa, Homo sapiens
YIISGDSPL

SEQ ID NO: 678 - protein, 9 aa, Homo sapiens
YIISGDSWV

SEQ ID NO: 679 - protein, 9 aa, Homo sapiens
YIISGISPV

SEQ ID NO: 680 - protein, 10 aa, Human papillomavirus type 52
YILDLQPETT

SEQ ID NO: 681 - protein, 10 aa, Human betaherpesvirus 5
YILEETSVLL

SEQ ID NO: 682 - protein, 10 aa, Human betaherpesvirus 5
YILEETSVLM

SEQ ID NO: 683 - protein, 9 aa, Human betaherpesvirus 5
YILEETSVM

SEQ ID NO: 684 - protein, 10 aa, human herpesvirus 1
YILEETSVML

SEQ ID NO: 685 - protein, 10 aa, Human betaherpesvirus 5
YILEETSVMM

SEQ ID NO: 686 - protein, 10 aa, human herpesvirus 1
YILGADPLRV

SEQ ID NO: 687 - protein, 9 aa, Vaccinia virus
YITALNHLV

SEQ ID NO: 688 - protein, 9 aa, Hepatitis C virus
YIVRWEWVV

SEQ ID NO: 689 - protein, 9 aa, Vaccinia virus
YIYGIPLSL

SEQ ID NO: 690 - protein, 10 aa, Trypanosoma cruzi
YLAAYALVGL

SEQ ID NO: 691 - protein, 9 aa, Dermatophagoides pteronyssinus
YLAYRNQSL

SEQ ID NO: 692 - protein, 10 aa, Lymphocytic choriomeningitis virus
YLCRHCLNLL

SEQ ID NO: 693 - protein, 9 aa, Vaccinia virus
YLDGQLARL

SEQ ID NO: 694 - protein, 9 aa, Plasmodium vivax
YLDKVRATV

SEQ ID NO: 695 - protein, 10 aa, Vaccinia virus
YLDNLLPSTL

SEQ ID NO: 696 - protein, 9 aa, Homo sapiens
YLEPGPVTA

SEQ ID NO: 697 - protein, 9 aa, Homo sapiens
YLEPGPVTV

SEQ ID NO: 698 - protein, 9 aa, human herpesvirus 1
YLESFCEDV

SEQ ID NO: 699 - protein, 9 aa, Vaccinia virus
YLFLICHNL

SEQ ID NO: 700 - protein, 10 aa, Vaccinia virus
YLIDTTSREL

SEQ ID NO: 701 - protein, 9 aa, Yellow fever virus
YLIIGILTL

SEQ ID NO: 702 - protein, 9 aa, Vaccinia virus
YLIKLIEPV

SEQ ID NO: 703 - protein, 9 aa, Homo sapiens
YLISGDSPV

SEQ ID NO: 704 - protein, 9 aa, Plasmodium falciparum
YLKKIKNSL

SEQ ID NO: 705 - protein, 9 aa, Plasmodium falciparum
YLKKIQNSL

SEQ ID NO: 706 - protein, 9 aa, Mycobacterium tuberculosis
YLLDGLRAQ

SEQ ID NO: 707 - protein, 9 aa, Homo sapiens
YLLEKSRAI

SEQ ID NO: 708 - protein, 9 aa, Human herpesvirus 4
YLLEMLWRL

SEQ ID NO: 709 - protein, 9 aa, Homo sapiens
YLLKPVQRI

SEQ ID NO: 710 - protein, 9 aa, Homo sapiens
YLLPAIVHI

SEQ ID NO: 711 - protein, 10 aa, Hepatitis C virus
YLLPRRGPRL

SEQ ID NO: 712 - protein, 10 aa, Hepatitis C virus
YLLPSRGPKL

SEQ ID NO: 713 - protein, 9 aa, Plasmodium falciparum
YLNKIQNSL

SEQ ID NO: 714 - protein, 9 aa, Vaccinia virus
YLPEVISTI

SEQ ID NO: 715 - protein, 9 aa, Vaccinia virus
YLPLSVFII

SEQ ID NO: 716 - protein, 9 aa, Human gammaherpesvirus 4
YLQQNWWTL

SEQ ID NO: 717 - protein, 9 aa, Vaccinia virus
YLSAKITTL

SEQ ID NO: 718 - protein, 9 aa, Homo sapiens
YLSGANLNL

SEQ ID NO: 719 - protein, 9 aa, Hepatitis C virus
YLVAYQATV

SEQ ID NO: 720 - protein, 9 aa, Lymphocytic choriomeningitis virus
YLVSIFLHL

SEQ ID NO: 721 - protein, 9 aa, Hepatitis C virus
YLVTRHADV

SEQ ID NO: 722 - protein, 9 aa, Human lymphotropic virus type I
YLYQLSPPI

SEQ ID NO: 723 - protein, 10 aa, Vaccinia virus
YLYTEYFLFL

SEQ ID NO: 724 - protein, 9 aa, Homo sapiens
YMDGTMSQV

SEQ ID NO: 725 - protein, 9 aa, Human papillomavirus type 16
YMLDLQPET

SEQ ID NO: 726 - protein, 10 aa, Human adenovirus type 16
YMLDLQPETT

SEQ ID NO: 727 - protein, 9 aa, Homo sapiens
YMNGTMSQV

SEQ ID NO: 728 - protein, 11 aa, Human betaherpesvirus 5
YSEHPTFTSQY

SEQ ID NO: 729 - protein, 9 aa, West Nile virus
YTMDGEYRL

SEQ ID NO: 730 - protein, 9 aa, Hepatitis C virus
YTMDGEYRL

SEQ ID NO: 731 - protein, 9 aa, Human gammaherpesvirus 4
YVLDHLIVV

SEQ ID NO: 732 - protein, 10 aa, Human papillomavirus type 31
YVLDLQPEAT

SEQ ID NO: 733 - protein, 10 aa, Human betaherpesvirus 5
YVLEETSVLL

SEQ ID NO: 734 - protein, 9 aa, Human betaherpesvirus 5
YVLEETSVM

SEQ ID NO: 735 - protein, 10 aa, human herpesvirus 1
YVLEETSVML

SEQ ID NO: 736 - protein, 10 aa, Human adenovirus type 5
YVLFEVFDVV

SEQ ID NO: 737 - protein, 9 aa, Vaccinia virus
YVNAILYQI

SEQ ID NO: 738 - protein, 10 aa, Human gammaherpesvirus 4
CLGGLLTMVA

SEQ ID NO: 739 - protein, 11 aa, Human gammaherpesvirus 4
CLGGLLTMVAG

SEQ ID NO: 740 - protein, 9 aa, Human gammaherpesvirus 4
AFLGERVTL

SEQ ID NO: 741 - protein, 9 aa, Human gammaherpesvirus 4
FLGERVTLT

SEQ ID NO: 742 - protein, 9 aa, Human gammaherpesvirus 4
KLGPGEEQV

SEQ ID NO: 743 - protein, 9 aa, Human gammaherpesvirus 4
RFIAQLLLL

SEQ ID NO: 744 - protein, 9 aa, Human gammaherpesvirus 4
TLTSYWRRV

SEQ ID NO: 745 - protein, 9 aa, Homo sapiens
FAYDGKDYI

SEQ ID NO: 746 - protein, 9 aa, Homo sapiens
FAYDGKDYL

SEQ ID NO: 747 - protein, 9 aa, Homo sapiens
FVLPELPSV

SEQ ID NO: 748 - protein, 10 aa, Homo sapiens
KQLDDLKVEL

SEQ ID NO: 749 - protein, 10 aa, Artificial Sequence
  unknown
YGILGFVFTL

SEQ ID NO: 750 - protein, 10 aa, Vaccinia virus
DIRTLLPILL

SEQ ID NO: 751 - protein, 9 aa, Vaccinia virus
EINNELELV

SEQ ID NO: 752 - protein, 9 aa, Vaccinia virus
FIFLKKNEL

SEQ ID NO: 753 - protein, 9 aa, Vaccinia virus
KLIIDREVV

SEQ ID NO: 754 - protein, 9 aa, Vaccinia virus
KLTFLDVEV

SEQ ID NO: 755 - protein, 10 aa, Vaccinia virus
PITDSLSFKL

SEQ ID NO: 756 - protein, 9 aa, Human alphaherpesvirus 3
SAPLPSNRV

SEQ ID NO: 757 - protein, 9 aa, Human alphaherpesvirus 3
SLPRSRTPI

SEQ ID NO: 758 - protein, 9 aa, Vaccinia virus
YIIKKNDIV

SEQ ID NO: 759 - protein, 9 aa, Mycobacterium tuberculosis
AIYDTMQYV

SEQ ID NO: 760 - protein, 9 aa, Mycobacterium tuberculosis
GLAGGAATA

SEQ ID NO: 761 - protein, 9 aa, Mycobacterium tuberculosis
LLYDGSFAV

SEQ ID NO: 762 - protein, 9 aa, human herpesvirus 1
AMAGASTSA

SEQ ID NO: 763 - protein, 10 aa, human herpesvirus 1
FTWPPWQAGI

SEQ ID NO: 764 - protein, 10 aa, Homo sapiens
GVYDGREHTV

SEQ ID NO: 765 - protein, 10 aa, human herpesvirus 1
KISHIMLDVA

SEQ ID NO: 766 - protein, 9 aa, human herpesvirus 1
KYQEFFWDA

SEQ ID NO: 767 - protein, 10 aa, human herpesvirus 1
LLCPKSIPGL

SEQ ID NO: 768 - protein, 10 aa, human herpesvirus 1
SDNEIHNPAV

SEQ ID NO: 769 - protein, 9 aa, human herpesvirus 1
SLILVSQYT

SEQ ID NO: 770 - protein, 9 aa, Hepatitis C virus
CINGVCWSI

SEQ ID NO: 771 - protein, 9 aa, Hepatitis C virus
CINGVCWSV

SEQ ID NO: 772 - protein, 9 aa, Hepatitis C virus
CISGVCWTV

SEQ ID NO: 773 - protein, 9 aa, Homo sapiens
VMAPRTVLL

SEQ ID NO: 774 - protein, 10 aa, Homo sapiens
MLLSVPLLLG

SEQ ID NO: 775 - protein, 9 aa, Influenza A virus
FVANFSMEL

SEQ ID NO: 776 - protein, 10 aa, Hepatitis C virus
GIDPNIRTGV

SEQ ID NO: 777 - protein, 10 aa, Hepatitis C virus
GVDPNIRTGV

SEQ ID NO: 778 - protein, 8 aa, Influenza A virus
ILGFVFTL

SEQ ID NO: 779 - protein, 10 aa, Trypanosoma cruzi
FLSHNFTLVF

SEQ ID NO: 780 - protein, 10 aa, Trypanosoma cruzi
SLSHYFTLVF

SEQ ID NO: 781 - protein, 9 aa, Homo sapiens
VMAPRALLL

SEQ ID NO: 782 - protein, 9 aa, Homo sapiens
ALWMRLLPL

SEQ ID NO: 783 - protein, 9 aa, Homo sapiens
FLFAVGFYL

SEQ ID NO: 784 - protein, 9 aa, Homo sapiens
FLIVLSVAL

SEQ ID NO: 785 - protein, 9 aa, Homo sapiens
FLWSVFMLI

SEQ ID NO: 786 - protein, 10 aa, Homo sapiens
GIVEQCCTSI

SEQ ID NO: 787 - protein, 9 aa, Homo sapiens
HLVEALYLV

SEQ ID NO: 788 - protein, 9 aa, Homo sapiens
KLQVFLIVL

SEQ ID NO: 789 - protein, 9 aa, Homo sapiens
LLPPLLEHL

SEQ ID NO: 790 - protein, 9 aa, Homo sapiens
RLLCALTSL

SEQ ID NO: 791 - protein, 9 aa, Homo sapiens
SLAAGVKLL

SEQ ID NO: 792 - protein, 10 aa, Homo sapiens
SLQKRGIVEQ

SEQ ID NO: 793 - protein, 9 aa, Homo sapiens
SLQPLALEG

SEQ ID NO: 794 - protein, 9 aa, Homo sapiens
SLSPLQAEL

SEQ ID NO: 795 - protein, 9 aa, Homo sapiens
SLYQLENYC

SEQ ID NO: 796 - protein, 9 aa, Homo sapiens
VMAPRTLLL

SEQ ID NO: 797 - protein, 9 aa, Homo sapiens
ALTAVAEEV

SEQ ID NO: 798 - protein, 9 aa, Homo sapiens
FLQDVMNIL

SEQ ID NO: 799 - protein, 9 aa, Homo sapiens
LLQEYNWEL

SEQ ID NO: 800 - protein, 10 aa, Homo sapiens
RMMEYGTTMV

SEQ ID NO: 801 - protein, 10 aa, Homo sapiens
SLYHVYEVNL

SEQ ID NO: 802 - protein, 9 aa, Homo sapiens
TIADFWQMV

SEQ ID NO: 803 - protein, 10 aa, Homo sapiens
VCGERGFFYT

SEQ ID NO: 804 - protein, 9 aa, Homo sapiens
VIVMLTPLV

SEQ ID NO: 805 - protein, 10 aa, Homo sapiens
VMNILLQYVV

SEQ ID NO: 806 - protein, 10 aa, Homo sapiens
ALWGPDPAAA

SEQ ID NO: 807 - protein, 9 aa, Homo sapiens
LNIDLLWSV

SEQ ID NO: 808 - protein, 9 aa, Homo sapiens
RLLPLLALL

SEQ ID NO: 809 - protein, 9 aa, Homo sapiens
VLFGLGFAI

SEQ ID NO: 810 - protein, 8 aa, Homo sapiens
WGPDPAAA

SEQ ID NO: 811 - protein, 10 aa, Homo sapiens
SHLVEALYLV

SEQ ID NO: 812 - protein, 9 aa, Homo sapiens
VMNILLQYV

SEQ ID NO: 813 - protein, 9 aa, Homo sapiens
FQDENYLYL

SEQ ID NO: 814 - protein, 9 aa, Homo sapiens
ELAEYLYNI

SEQ ID NO: 815 - protein, 9 aa, Homo sapiens
ILMHCQTTL

SEQ ID NO: 816 - protein, 9 aa, Homo sapiens
FLWSVFWLI

SEQ ID NO: 817 - protein, 9 aa, Human gammaherpesvirus 4
ILLARLFLY

SEQ ID NO: 818 - protein, 9 aa, Human gammaherpesvirus 4
LIVDAVLQL

SEQ ID NO: 819 - protein, 9 aa, Human gammaherpesvirus 4
TVCGGIMFL

SEQ ID NO: 820 - protein, 10 aa, Homo sapiens
ALWMRLLPLL

SEQ ID NO: 821 - protein, 10 aa, Homo sapiens
LCGSHLVEAL

SEQ ID NO: 822 - protein, 9 aa, Homo sapiens
LLDVAPLSL

SEQ ID NO: 823 - protein, 9 aa, Homo sapiens
LLLLDVAPL

SEQ ID NO: 824 - protein, 9 aa, Homo sapiens
LMGDKSENV

SEQ ID NO: 825 - protein, 9 aa, Human gammaherpesvirus 4
CLGGLLTMN

SEQ ID NO: 826 - protein, 10 aa, Human gammaherpesvirus 4
LLDFVRFMGY

SEQ ID NO: 827 - protein, 9 aa, Human gammaherpesvirus 4
QLLQHYREV

SEQ ID NO: 828 - protein, 9 aa, Human gammaherpesvirus 4
VMATLLPPV

SEQ ID NO: 829 - protein, 9 aa, Human papillomavirus type 16
ALQAIELQL

SEQ ID NO: 830 - protein, 9 aa, Mycobacterium tuberculosis
FLLGLLFFV

SEQ ID NO: 831 - protein, 9 aa, Mycobacterium tuberculosis
FLYELIWNV

SEQ ID NO: 832 - protein, 9 aa, Human papillomavirus type 16
TLQDVSLEV

SEQ ID NO: 833 - protein, 9 aa, Yellow fever virus
VLAGWLFHV

SEQ ID NO: 834 - protein, 10 aa, Human papillomavirus type 16
YICEEASVTV

SEQ ID NO: 835 - protein, 9 aa, Human papillomavirus type 11
DLLLGTLNI

SEQ ID NO: 836 - protein, 9 aa, Human papillomavirus type 18
FQQLFLNTL

SEQ ID NO: 837 - protein, 9 aa, Human papillomavirus type 6
LLLGTLNIV

SEQ ID NO: 838 - protein, 9 aa, Human rotavirus
LLNYILKSV

SEQ ID NO: 839 - protein, 9 aa, Human papillomavirus type 11
LQPPDPVGL

SEQ ID NO: 840 - protein, 9 aa, Human papillomavirus type 11
PLTQHYQIL

SEQ ID NO: 841 - protein, 9 aa, Human papillomavirus type 11
TLKDIVLDL

SEQ ID NO: 842 - protein, 10 aa, Human papillomavirus type 16
TLLQQYCLYL

SEQ ID NO: 843 - protein, 9 aa, Human papillomavirus type 18
TLQDIVLHL

SEQ ID NO: 844 - protein, 9 aa, Human papillomavirus type 16
FLLCFCVLL

SEQ ID NO: 845 - protein, 9 aa, Human papillomavirus type 16
ICWGNQLFV

SEQ ID NO: 846 - protein, 9 aa, Human papillomavirus type 16
VLLCVCLLI

SEQ ID NO: 847 - protein, 9 aa, Human papillomavirus type 16
VLLLWITAA

SEQ ID NO: 848 - protein, 9 aa, Human papillomavirus type 16
YIIFVYIPL

SEQ ID NO: 849 - protein, 9 aa, Hepatitis B virus
KLVCSPAPC

SEQ ID NO: 850 - protein, 9 aa, Human papillomavirus type 18
ELTEVFEFA

SEQ ID NO: 851 - protein, 9 aa, Human papillomavirus type 18
FAFKDLFVV

SEQ ID NO: 852 - protein, 9 aa, Human papillomavirus type 18
KCIDFYSRI

SEQ ID NO: 853 - protein, 9 aa, Human papillomavirus type 16
KISEYRHYC

SEQ ID NO: 854 - protein, 10 aa, Human papillomavirus type 18
KLTNTGLYNL

SEQ ID NO: 855 - protein, 9 aa, Human papillomavirus type 18
KTVLELTEV

SEQ ID NO: 856 - protein, 9 aa, Human papillomavirus type 18
LFLNTLSFV

SEQ ID NO: 857 - protein, 9 aa, Human papillomavirus type 18
LQDIEITCV

SEQ ID NO: 858 - protein, 10 aa, Human papillomavirus type 18
SLQDIEITCV

SEQ ID NO: 859 - protein, 11 aa, Vaccinia virus
IPDEQKTIIGL

SEQ ID NO: 860 - protein, 10 aa, Vaccinia virus
KITSYKFESV

SEQ ID NO: 861 - protein, 9 aa, Vaccinia virus
KLFSDISAI

SEQ ID NO: 862 - protein, 9 aa, Vaccinia virus
KLIIHNPEL

SEQ ID NO: 863 - protein, 9 aa, Vaccinia virus
SLKDVLVSV

SEQ ID NO: 864 - protein, 9 aa, Vaccinia virus
TLLDHIRTA

SEQ ID NO: 865 - protein, 9 aa, Toxoplasma gondii
LLFSFAQAV

SEQ ID NO: 866 - protein, 9 aa, Human gammaherpesvirus 4
TLDTKPLSV

SEQ ID NO: 867 - protein, 9 aa, Homo sapiens
NLAQDLATV

SEQ ID NO: 868 - protein, 9 aa, Homo sapiens
QLARQQVHV

SEQ ID NO: 869 - protein, 9 aa, Homo sapiens
SLEEEIRFL

SEQ ID NO: 870 - protein, 9 aa, Homo sapiens
ALLDQLHTL

SEQ ID NO: 871 - protein, 9 aa, Homo sapiens
ALNNLLHSL

SEQ ID NO: 872 - protein, 9 aa, Homo sapiens
KQLEVVHTL

SEQ ID NO: 873 - protein, 9 aa, Homo sapiens
GLMTTVHAI

SEQ ID NO: 874 - protein, 9 aa, Homo sapiens
IVIGVLHQL

SEQ ID NO: 875 - protein, 9 aa, Homo sapiens
QLNEQVHSL

SEQ ID NO: 876 - protein, 9 aa, Homo sapiens
QQLQIIHRV

SEQ ID NO: 877 - protein, 9 aa, Homo sapiens
RQIFNGTFV

SEQ ID NO: 878 - protein, 9 aa, Homo sapiens
SALGYLHSI

SEQ ID NO: 879 - protein, 9 aa, Homo sapiens
SMMDVDHQI

SEQ ID NO: 880 - protein, 9 aa, Homo sapiens
SMTLAIHEI

SEQ ID NO: 881 - protein, 9 aa, Homo sapiens
TLTNVIHNL

SEQ ID NO: 882 - protein, 9 aa, Homo sapiens
KLIETYFSK

SEQ ID NO: 883 - protein, 9 aa, Vaccinia virus
KISNTTFEV

SEQ ID NO: 884 - protein, 9 aa, Vaccinia virus
KLSDSKITV

SEQ ID NO: 885 - protein, 9 aa, Vaccinia virus
KLVGKTVKV

SEQ ID NO: 886 - protein, 10 aa, Vaccinia virus
SLLFIPDIKL

SEQ ID NO: 887 - protein, 9 aa, Vaccinia virus
VLSLELPEV

SEQ ID NO: 888 - protein, 10 aa, Homo sapiens
EVGGEALGRL

SEQ ID NO: 889 - protein, 9 aa, Homo sapiens
FVNDIFERI

SEQ ID NO: 890 - protein, 11 aa, Homo sapiens
PKFEVIEKPQA

SEQ ID NO: 891 - protein, 10 aa, Homo sapiens
RLYPWGVVEV

SEQ ID NO: 892 - protein, 11 aa, Homo sapiens
TIIDLPGITRV

SEQ ID NO: 893 - protein, 10 aa, Homo sapiens
TIQKSSLDQL

SEQ ID NO: 894 - protein, 11 aa, Homo sapiens
VVIRGNSIIML

SEQ ID NO: 895 - protein, 9 aa, Yellow fever virus
LLWNGPMAV

SEQ ID NO: 896 - protein, 9 aa, Pseudomonas aeruginosa
ALAEGDLLA

SEQ ID NO: 897 - protein, 10 aa, Homo sapiens
GLEALVPLAV

SEQ ID NO: 898 - protein, 10 aa, Homo sapiens
GLLDKAVSNV

SEQ ID NO: 899 - protein, 9 aa, Homo sapiens
GMVTTSTTL

SEQ ID NO: 900 - protein, 10 aa, Homo sapiens
KAFLTQLDEL

SEQ ID NO: 901 - protein, 9 aa, Homo sapiens
KLSEGDLLA

SEQ ID NO: 902 - protein, 10 aa, Homo sapiens
LLDKAVSNVI

SEQ ID NO: 903 - protein, 10 aa, Homo sapiens
RLLDLAQEGL

SEQ ID NO: 904 - protein, 10 aa, Homo sapiens
TTLITNLSSV

SEQ ID NO: 905 - protein, 9 aa, Homo sapiens
VLNEQVKEA

SEQ ID NO: 906 - protein, 8 aa, SARS coronavirus
ILLNKHID

SEQ ID NO: 907 - protein, 9 aa, Vaccinia virus
AINVEKIEL

SEQ ID NO: 908 - protein, 9 aa, Vaccinia virus
DLKPDNILL

SEQ ID NO: 909 - protein, 10 aa, Vaccinia virus
EIVNLLDNKV

SEQ ID NO: 910 - protein, 10 aa, Vaccinia virus
ELNAELSDKL

SEQ ID NO: 911 - protein, 9 aa, Mycobacterium tuberculosis
FMYEGDTPL

SEQ ID NO: 912 - protein, 10 aa, Vaccinia virus
ILFPDDVQEL

SEQ ID NO: 913 - protein, 9 aa, Vaccinia virus
ILNDEQLNL

SEQ ID NO: 914 - protein, 10 aa, Vaccinia virus
KIDTTHVSKV

SEQ ID NO: 915 - protein, 9 aa, Vaccinia virus
KIEIERKKL

SEQ ID NO: 916 - protein, 9 aa, Vaccinia virus
KLGFEEIKG

SEQ ID NO: 917 - protein, 9 aa, Vaccinia virus
KLGIGNSPV

SEQ ID NO: 918 - protein, 11 aa, Human immunodeficiency virus
KSLFNTIATLY

SEQ ID NO: 919 - protein, 10 aa, Human immunodeficiency virus
KSLFNTIAVL

SEQ ID NO: 920 - protein, 11 aa, Human immunodeficiency virus
KSLFNTIAVLY

SEQ ID NO: 921 - protein, 10 aa, Human immunodeficiency virus
KSLFNTVATL

SEQ ID NO: 922 - protein, 11 aa, Human immunodeficiency virus
KSLFNTVATLY

SEQ ID NO: 923 - protein, 10 aa, Human immunodeficiency virus
KSLFNTVAVL

SEQ ID NO: 924 - protein, 11 aa, Human immunodeficiency virus
KSLFNTVAVLY

SEQ ID NO: 925 - protein, 11 aa, Human immunodeficiency virus
KSLYNTIATLY

SEQ ID NO: 926 - protein, 11 aa, Human immunodeficiency virus
KSLYNTIAVLY

SEQ ID NO: 927 - protein, 10 aa, Human immunodeficiency virus
KSLYNTVATL

SEQ ID NO: 928 - protein, 11 aa, Human immunodeficiency virus
KSLYNTVATLY

SEQ ID NO: 929 - protein, 11 aa, Human immunodeficiency virus
KSLYNTVAVLY

SEQ ID NO: 930 - protein, 9 aa, Vaccinia virus
LIDNPDNNL

SEQ ID NO: 931 - protein, 9 aa, Vaccinia virus
LLFLKDVEP

SEQ ID NO: 932 - protein, 8 aa, Vaccinia virus
LLVNEFYI

SEQ ID NO: 933 - protein, 9 aa, Vaccinia virus WR
LVEKVLKIL

SEQ ID NO: 934 - protein, 10 aa, Vaccinia virus WR
LVSIPRTNIV

SEQ ID NO: 935 - protein, 9 aa, Vaccinia virus WR
MPQMKKILK

SEQ ID NO: 936 - protein, 9 aa, Vaccinia virus WR
QVKDEKLNL

SEQ ID NO: 937 - protein, 11 aa, Human immunodeficiency virus 1
RSLFNTIATLY

SEQ ID NO: 938 - protein, 11 aa, Human immunodeficiency virus 1
RSLFNTIAVLY

SEQ ID NO: 939 - protein, 10 aa, Human immunodeficiency virus 1
RSLFNTVATL

SEQ ID NO: 940 - protein, 11 aa, Human immunodeficiency virus 1
RSLFNTVATLY

SEQ ID NO: 941 - protein, 11 aa, Human immunodeficiency virus 1
RSLFNTVAVLY

SEQ ID NO: 942 - protein, 11 aa, Human immunodeficiency virus 1
RSLYNTIATLY

SEQ ID NO: 943 - protein, 11 aa, Human immunodeficiency virus 1
RSLYNTIAVLY

SEQ ID NO: 944 - protein, 10 aa, Human immunodeficiency virus 1
RSLYNTVATL

SEQ ID NO: 945 - protein, 11 aa, Human immunodeficiency virus 1
RSLYNTVATLY

SEQ ID NO: 946 - protein, 10 aa, Human immunodeficiency virus 1
RSLYNTVAVL

SEQ ID NO: 947 - protein, 11 aa, Human immunodeficiency virus 1
RSLYNTVAVLY

SEQ ID NO: 948 - protein, 10 aa, Human immunodeficiency virus 1
SLFNTIAVLY

SEQ ID NO: 949 - protein, 10 aa, Human immunodeficiency virus 1
SLFNTVATLY

SEQ ID NO: 950 - protein, 10 aa, Vaccinia virus WR
SLYNLVKSSV

SEQ ID NO: 951 - protein, 9 aa, Homo sapiens
ALDKATVLL

SEQ ID NO: 952 - protein, 9 aa, Homo sapiens
ALKDKIEKA

SEQ ID NO: 953 - protein, 9 aa, Homo sapiens
ALNDHFVKL

SEQ ID NO: 954 - protein, 9 aa, Homo sapiens
ALNEKLVNL

SEQ ID NO: 955 - protein, 9 aa, Homo sapiens
AVSDGVIKV

SEQ ID NO: 956 - protein, 9 aa, Homo sapiens
FAGDDAPRA

SEQ ID NO: 957 - protein, 10 aa, Homo sapiens
FIQTQQLHAA

SEQ ID NO: 958 - protein, 10 aa, Homo sapiens
FLAEEGFYKF

SEQ ID NO: 959 - protein, 10 aa, Homo sapiens
FLDLEPIPGA

SEQ ID NO: 960 - protein, 8 aa, Homo sapiens
FLLSLLIL

SEQ ID NO: 961 - protein, 9 aa, Homo sapiens
FLPSYIIDV

SEQ ID NO: 962 - protein, 8 aa, Homo sapiens
FVFPGELL

SEQ ID NO: 963 - protein, 10 aa, Homo sapiens
GIVEGLMTTV

SEQ ID NO: 964 - protein, 9 aa, Homo sapiens
GIWGFIKGV

SEQ ID NO: 965 - protein, 9 aa, Homo sapiens
GLDIPTVQV

SEQ ID NO: 966 - protein, 8 aa, Homo sapiens
GLFDTAIS

SEQ ID NO: 967 - protein, 9 aa, Homo sapiens
GLIDGRLTI

SEQ ID NO: 968 - protein, 11 aa, Homo sapiens
GLIKGSGTAEV

SEQ ID NO: 969 - protein, 10 aa, Homo sapiens
GLQDFDLLRV

SEQ ID NO: 970 - protein, 9 aa, Homo sapiens
GQIGQLPQA

SEQ ID NO: 971 - protein, 9 aa, Homo sapiens
GVLPNIQAV

SEQ ID NO: 972 - protein, 10 aa, Homo sapiens
IIMLEALERV

SEQ ID NO: 973 - protein, 9 aa, Homo sapiens
IINEPTAAA

SEQ ID NO: 974 - protein, 9 aa, Homo sapiens
IIPASTGAA

SEQ ID NO: 975 - protein, 12 aa, Homo sapiens
ILAADFEIGHFL

SEQ ID NO: 976 - protein, 9 aa, Homo sapiens
ILGYTEHQV

SEQ ID NO: 977 - protein, 9 aa, Homo sapiens
ILSGVVTKM

SEQ ID NO: 978 - protein, 9 aa, Homo sapiens
KLDQDLNEV

SEQ ID NO: 979 - protein, 11 aa, Homo sapiens
KLIGDPNLEFV

SEQ ID NO: 980 - protein, 11 aa, Homo sapiens
KLMELHGEGSS

SEQ ID NO: 981 - protein, 10 aa, Homo sapiens
KVFDPVPVGV

SEQ ID NO: 982 - protein, 8 aa, Homo sapiens
LLDVPTAA

SEQ ID NO: 983 - protein, 9 aa, Homo sapiens
LLDVTPLSL

SEQ ID NO: 984 - protein, 8 aa, Homo sapiens
LLDVVHPA

SEQ ID NO: 985 - protein, 9 aa, Homo sapiens
LLDVVHPAA

SEQ ID NO: 986 - protein, 9 aa, Homo sapiens
LLGPRLVLA

SEQ ID NO: 987 - protein, 9 aa, Homo sapiens
NLAEKPKTV

SEQ ID NO: 988 - protein, 9 aa, Homo sapiens
NLDPAVHEV

SEQ ID NO: 989 - protein, 9 aa, Homo sapiens
NMVAKVDEV

SEQ ID NO: 990 - protein, 9 aa, Homo sapiens
RVPPPPPIA

SEQ ID NO: 991 - protein, 9 aa, Homo sapiens
SLFEGTWYL

SEQ ID NO: 992 - protein, 9 aa, Homo sapiens
SLLDIIEKV

SEQ ID NO: 993 - protein, 9 aa, Homo sapiens
SLLEKSLGL

SEQ ID NO: 994 - protein, 9 aa, Homo sapiens
SMPDFDLHL

SEQ ID NO: 995 - protein, 9 aa, Homo sapiens
SQVPEVTTV

SEQ ID NO: 996 - protein, 12 aa, Homo sapiens
SVIDYELIDQDA

SEQ ID NO: 997 - protein, 11 aa, Homo sapiens
TLAEVERLKGL

SEQ ID NO: 998 - protein, 9 aa, Homo sapiens
TLAEVSTRL

SEQ ID NO: 999 - protein, 9 aa, Homo sapiens
TLAKYLMEL

SEQ ID NO: 1000 - protein, 11 aa, Homo sapiens
TLQEVFEKATF

SEQ ID NO: 1001 - protein, 10 aa, Homo sapiens
TLWDIQKDLK

SEQ ID NO: 1002 - protein, 9 aa, Homo sapiens
TLWGIQKEL

SEQ ID NO: 1003 - protein, 9 aa, Homo sapiens
TLYEHNNEL

SEQ ID NO: 1004 - protein, 11 aa, Homo sapiens
VLPTETEVAPA

SEQ ID NO: 1005 - protein, 9 aa, Homo sapiens
VVQDGIVKA

SEQ ID NO: 1006 - protein, 10 aa, Homo sapiens
YAYDGKDYIA

SEQ ID NO: 1007 - protein, 8 aa, Homo sapiens
YLFLGGIL

SEQ ID NO: 1008 - protein, 11 aa, Homo sapiens
LMTTVHAITAT

SEQ ID NO: 1009 - protein, 8 aa, Homo sapiens
SLFEGTWY

SEQ ID NO: 1010 - protein, 9 aa, Homo sapiens
AIIGGTFTV

SEQ ID NO: 1011 - protein, 10 aa, Homo sapiens
YVPEDEDLKK

SEQ ID NO: 1012 - protein, 13 aa, Human T-lymphotropic virus 1
LLFGKPVYVSCMK

SEQ ID NO: 1013 - protein, 10 aa, Homo sapiens
FLLKAEVQKL

SEQ ID NO: 1014 - protein, 9 aa, HIV-1 M:A
SLFNTVATL

SEQ ID NO: 1015 - protein, 9 aa, Homo sapiens
SLVEELKKV

SEQ ID NO: 1016 - protein, 9 aa, Homo sapiens
VLAEELHKV

SEQ ID NO: 1017 - protein, 9 aa, Homo sapiens
SLMSWSAIL

SEQ ID NO: 1018 - protein, 10 aa, Homo sapiens
FLMLVGGSTL

SEQ ID NO: 1019 - protein, 10 aa, Homo sapiens
MLVGGSTLCV

SEQ ID NO: 1020 - protein, 10 aa, Homo sapiens
QLGPTCLSSL

SEQ ID NO: 1021 - protein, 10 aa, Homo sapiens
SLLGQLSGQV

SEQ ID NO: 1022 - protein, 10 aa, Homo sapiens
TLLLEGVMAA

SEQ ID NO: 1023 - protein, 10 aa, Homo sapiens
YLAPENGYLM

SEQ ID NO: 1024 - protein, 9 aa, Homo sapiens
ALLNIKVKL

SEQ ID NO: 1025 - protein, 9 aa, Human betaherpesvirus 5
NLVGMVATV

SEQ ID NO: 1026 - protein, 9 aa, Human betaherpesvirus 5
NLVPMVASV

SEQ ID NO: 1027 - protein, 9 aa, Homo sapiens
RLASYLDKV

SEQ ID NO: 1028 - protein, 9 aa, Dengue virus 1
AIVREAIKR

SEQ ID NO: 1029 - protein, 9 aa, Leptospira interrogans serovar Pomona
KLIVTPAAL

SEQ ID NO: 1030 - protein, 9 aa, Homo sapiens
MLLSVPLLL

SEQ ID NO: 1031 - protein, 9 aa, Dengue virus 1
SRNSTHEMY

SEQ ID NO: 1032 - protein, 9 aa, Dengue virus 1
TLYAVATTI

SEQ ID NO: 1033 - protein, 10 aa, Influenza A virus (A/Bar-headed Goose/Qinghai/61/05(H5N1))
RLYQNPTTYI

SEQ ID NO: 1034 - protein, 9 aa, Human betaherpesvirus 5
NLVAMVATV

SEQ ID NO: 1035 - protein, 9 aa, Human betaherpesvirus 5
NLVPQVATV

SEQ ID NO: 1036 - protein, 9 aa, Human betaherpesvirus 5
NLVPTVATV

SEQ ID NO: 1037 - protein, 9 aa, Human betaherpesvirus 5
NLVPVVATV

SEQ ID NO: 1038 - protein, 9 aa, Mycobacterium tuberculosis H37Rv
AVADHVAAV

SEQ ID NO: 1039 - protein, 11 aa, Hepatitis C virus
FLLALLSCLTV

SEQ ID NO: 1040 - protein, 9 aa, Homo sapiens
VLHDDLLEA

SEQ ID NO: 1041 - protein, 9 aa, Homo sapiens
FIDSYICQV

SEQ ID NO: 1042 - protein, 9 aa, Homo sapiens
GVLVGVALI

SEQ ID NO: 1043 - protein, 9 aa, Homo sapiens
YLDPAQQNL

SEQ ID NO: 1044 - protein, 9 aa, Human herpesvirus 5 strain AD169
RQYDPVAAL

SEQ ID NO: 1045 - protein, 9 aa, Human herpesvirus 5 strain AD169
VAALFFFDI

SEQ ID NO: 1046 - protein, 10 aa, Homo sapiens
ELAGWGILTV

SEQ ID NO: 1047 - protein, 10 aa, Homo sapiens
LLAGIGTVPI

SEQ ID NO: 1048 - protein, 9 aa, Homo sapiens
FLWGPRAYA

SEQ ID NO: 1049 - protein, 9 aa, Homo sapiens
RLQGISPKI

SEQ ID NO: 1050 - protein, 9 aa, Homo sapiens
FLLPILSQI

SEQ ID NO: 1051 - protein, 9 aa, Vaccinia virus Copenhagen
RIIYIIRFL

SEQ ID NO: 1052 - protein, 10 aa, Homo sapiens
SLMASSPTSI

SEQ ID NO: 1053 - protein, 9 aa, Homo sapiens
YIGEVLVSV

SEQ ID NO: 1054 - protein, 9 aa, Homo sapiens
YSLEYFQFV

SEQ ID NO: 1055 - protein, 11 aa, Homo sapiens
CIPPDSLLFPA

SEQ ID NO: 1056 - protein, 9 aa, Homo sapiens
FLVQNIHTL

SEQ ID NO: 1057 - protein, 9 aa, Homo sapiens
KLHDVEHVL

SEQ ID NO: 1058 - protein, 10 aa, Human papillomavirus type 16
RTLEDLLMGT

SEQ ID NO: 1059 - protein, 9 aa, Homo sapiens
YAIKNIHGV

SEQ ID NO: 1060 - protein, 9 aa, Toxoplasma gondii
FAAAFFPAV

SEQ ID NO: 1061 - protein, 9 aa, Toxoplasma gondii
FLLGLLVHV

SEQ ID NO: 1062 - protein, 9 aa, Toxoplasma gondii
FLSLSLLVI

SEQ ID NO: 1063 - protein, 9 aa, Toxoplasma gondii
FLTDYIPGA

SEQ ID NO: 1064 - protein, 9 aa, Toxoplasma gondii
FLVPFVVFL

SEQ ID NO: 1065 - protein, 9 aa, Toxoplasma gondi ME49
FMGVLVNSL

SEQ ID NO: 1066 - protein, 10 aa, Toxoplasma gondii
FMIAFISCFA

SEQ ID NO: 1067 - protein, 9 aa, Toxoplasma gondii
FMIVSISLV

SEQ ID NO: 1068 - protein, 9 aa, Toxoplasma gondii
FVIFACNFV

SEQ ID NO: 1069 - protein, 9 aa, Toxoplasma gondii
GLAAAVVAV

SEQ ID NO: 1070 - protein, 9 aa, Toxoplasma gondii
ITMGSLFFV

SEQ ID NO: 1071 - protein, 9 aa, Toxoplasma gondii
VLLPVLFGV

SEQ ID NO: 1072 - protein, 9 aa, Toxoplasma gondii ME49
VVFVVFMGV

SEQ ID NO: 1073 - protein, 9 aa, Homo sapiens
MVWESGCTV

SEQ ID NO: 1074 - protein, 9 aa, Mycobacterium tuberculosis H37Rv
ALDEGLLPV

SEQ ID NO: 1075 - protein, 9 aa, Mycobacterium tuberculosis H37Rv
ALLGGLRPV

SEQ ID NO: 1076 - protein, 9 aa, Mycobacterium tuberculosis H37Rv
AMAGSIDLL

SEQ ID NO: 1077 - protein, 9 aa, Mycobacterium tuberculosis H37Rv
GMFANRWII

SEQ ID NO: 1078 - protein, 9 aa, Mycobacterium tuberculosis H37Rv
HLDDVGFLV

SEQ ID NO: 1079 - protein, 9 aa, Mycobacterium tuberculosis H37Rv
SLIDLLHKI

SEQ ID NO: 1080 - protein, 9 aa, Mycobacterium tuberculosis H37Rv
SLRNWIATL

SEQ ID NO: 1081 - protein, 9 aa, Mycobacterium tuberculosis H37Rv
SLWKDGAPL

SEQ ID NO: 1082 - protein, 9 aa, Mycobacterium tuberculosis H37Rv
WLYPGAQNL

SEQ ID NO: 1083 - protein, 9 aa, Mycobacterium tuberculosis H37Rv
YLLADTFTV

SEQ ID NO: 1084 - protein, 9 aa, Mycobacterium tuberculosis
AMLGHAGDM

SEQ ID NO: 1085 - protein, 9 aa, Mycobacterium tuberculosis
MLGHAGDMA

SEQ ID NO: 1086 - protein, 9 aa, Mycobacterium tuberculosis H37Rv
MMARDTAEA

SEQ ID NO: 1087 - protein, 9 aa, Mycobacterium tuberculosis H37Rv
QAMEDLVRA

SEQ ID NO: 1088 - protein, 9 aa, Homo sapiens
QLVQSGAEV

SEQ ID NO: 1089 - protein, 9 aa, Homo sapiens
SLFLGILSV

SEQ ID NO: 1090 - protein, 9 aa, Mycobacterium tuberculosis H37Rv
SQIMYNYPA

SEQ ID NO: 1091 - protein, 9 aa, Homo sapiens
YLGEVIVSV

SEQ ID NO: 1092 - protein, 9 aa, Homo sapiens
YLGEVLVSV

SEQ ID NO: 1093 - protein, 10 aa, Homo sapiens
ALIDCNPCTL

SEQ ID NO: 1094 - protein, 10 aa, Homo sapiens
ALLMPAGVPL

SEQ ID NO: 1095 - protein, 10 aa, Homo sapiens
ALLPTALDAL

SEQ ID NO: 1096 - protein, 10 aa, Homo sapiens
CLLSGTYIFA

SEQ ID NO: 1097 - protein, 10 aa, Homo sapiens
FIFPASKVYL

SEQ ID NO: 1098 - protein, 9 aa, Homo sapiens
FLLDILGAT

SEQ ID NO: 1099 - protein, 9 aa, Homo sapiens
FLLENAAYL

SEQ ID NO: 1100 - protein, 10 aa, Homo sapiens
FLLENAAYLD

SEQ ID NO: 1101 - protein, 10 aa, Homo sapiens
FMHNRLQYSL

SEQ ID NO: 1102 - protein, 10 aa, Homo sapiens
FTHNEYKFYV

SEQ ID NO: 1103 - protein, 10 aa, Homo sapiens
HLLTSPKPSL

SEQ ID NO: 1104 - protein, 9 aa, Homo sapiens
KAFQDVLYV

SEQ ID NO: 1105 - protein, 10 aa, Homo sapiens
KLLSSGAFSA

SEQ ID NO: 1106 - protein, 10 aa, Homo sapiens
KLMPPDRTAV

SEQ ID NO: 1107 - protein, 9 aa, Homo sapiens
KLTQINFNM

SEQ ID NO: 1108 - protein, 9 aa, Homo sapiens
KMAAFPETL

SEQ ID NO: 1109 - protein, 9 aa, Homo sapiens
LLIADNPQL

SEQ ID NO: 1110 - protein, 9 aa, Homo sapiens
LLIKKLPRV

SEQ ID NO: 1111 - protein, 9 aa, Homo sapiens
LLMPAGVPL

SEQ ID NO: 1112 - protein, 10 aa, Homo sapiens
LLMPAGVPLT

SEQ ID NO: 1113 - protein, 9 aa, Homo sapiens
LLSSGAFSA

SEQ ID NO: 1114 - protein, 10 aa, Homo sapiens
LLVALAIGCV

SEQ ID NO: 1115 - protein, 9 aa, Homo sapiens
LLVSEIDWL

SEQ ID NO: 1116 - protein, 9 aa, Homo sapiens
LMASSPTSI

SEQ ID NO: 1117 - protein, 9 aa, Homo sapiens
NLATYMNSI

SEQ ID NO: 1118 - protein, 10 aa, Homo sapiens
NVMPVLDQSV

SEQ ID NO: 1119 - protein, 9 aa, Homo sapiens
QLLKLNVPA

SEQ ID NO: 1120 - protein, 10 aa, Homo sapiens
RLLIKKLPRV

SEQ ID NO: 1121 - protein, 9 aa, Homo sapiens
TLKKYFIPV

SEQ ID NO: 1122 - protein, 10 aa, Homo sapiens
YIFAVLLVCV

SEQ ID NO: 1123 - protein, 9 aa, Homo sapiens
YLDLLFQIL

SEQ ID NO: 1124 - protein, 10 aa, Homo sapiens
YLDLLFQILL

SEQ ID NO: 1125 - protein, 9 aa, Homo sapiens
YLLPEAEEI

SEQ ID NO: 1126 - protein, 9 aa, Homo sapiens
YLQQNTHTL

SEQ ID NO: 1127 - protein, 10 aa, Homo sapiens
YMIPSIRNSI

SEQ ID NO: 1128 - protein, 9 aa, Homo sapiens
YMNSIRLYA

SEQ ID NO: 1129 - protein, 9 aa, Human alphaherpesvirus 1
ALLDRDCRV

SEQ ID NO: 1130 - protein, 8 aa, Human gammaherpesvirus 4
CLGLLTMV

SEQ ID NO: 1131 - protein, 9 aa, Human alphaherpesvirus 1
FLADAVVRL

SEQ ID NO: 1132 - protein, 9 aa, Human alphaherpesvirus 1
FLIAYQPLL

SEQ ID NO: 1133 - protein, 9 aa, Human alphaherpesvirus 1
FLWEDQTLL

SEQ ID NO: 1134 - protein, 9 aa, Human alphaherpesvirus 1
ILIEGIFFA

SEQ ID NO: 1135 - protein, 9 aa, Human gammaherpesvirus 4
LLDFVRMGV

SEQ ID NO: 1136 - protein, 9 aa, Homo sapiens
PTLDKVLEL

SEQ ID NO: 1137 - protein, 9 aa, Homo sapiens
PTLDKVLEV

SEQ ID NO: 1138 - protein, 9 aa, Human alphaherpesvirus 1
RILGVLVHL

SEQ ID NO: 1139 - protein, 9 aa, Human alphaherpesvirus 1
RLLGFADTV

SEQ ID NO: 1140 - protein, 9 aa, Herpes simplex virus (type 1 / strain 17)
RLNELLAYV

SEQ ID NO: 1141 - protein, 9 aa, Homo sapiens
RTLDKVLEV

SEQ ID NO: 1142 - protein, 9 aa, Human alphaherpesvirus 1
SVYPYDEFV

SEQ ID NO: 1143 - protein, 9 aa, Human alphaherpesvirus 1
TLLELVVSV

SEQ ID NO: 1144 - protein, 9 aa, Homo sapiens
TAMDVVYAL

SEQ ID NO: 1145 - protein, 9 aa, Human gammaherpesvirus 8
ALISAFSGS

SEQ ID NO: 1146 - protein, 9 aa, Human gammaherpesvirus 8
AMLVLLAEI

SEQ ID NO: 1147 - protein, 9 aa, Human gammaherpesvirus 8
DGGDGNKTL

SEQ ID NO: 1148 - protein, 9 aa, Human gammaherpesvirus 8
GRRDPKCQW

SEQ ID NO: 1149 - protein, 9 aa, Human gammaherpesvirus 8
LVLILYLCV

SEQ ID NO: 1150 - protein, 10 aa, Human gammaherpesvirus 8
MLMIIIVIAI

SEQ ID NO: 1151 - protein, 9 aa, Human gammaherpesvirus 8
PESSQRPPL

SEQ ID NO: 1152 - protein, 9 aa, Human gammaherpesvirus 8
PLPLTQPGE

SEQ ID NO: 1153 - protein, 9 aa, Human gammaherpesvirus 8
PVVSTHEQI

SEQ ID NO: 1154 - protein, 10 aa, Human gammaherpesvirus 8
QQDEQQQQDE

SEQ ID NO: 1155 - protein, 9 aa, Human gammaherpesvirus 8
RLAAGSPSS

SEQ ID NO: 1156 - protein, 10 aa, Human gammaherpesvirus 8
SSMKVNVNGV

SEQ ID NO: 1157 - protein, 9 aa, Homo sapiens
TIMPKDIQL

SEQ ID NO: 1158 - protein, 10 aa, Human gammaherpesvirus 8
WRLGAIPPLV

SEQ ID NO: 1159 - protein, 12 aa, Homo sapiens
LHLGYLPNQLFR

SEQ ID NO: 1160 - protein, 9 aa, Hepatovirus A
ALFHEVAKL

SEQ ID NO: 1161 - protein, 9 aa, Hepatovirus A
LLYNCCYHV

SEQ ID NO: 1162 - protein, 9 aa, Hepatovirus A
MMFGFHHSV

SEQ ID NO: 1163 - protein, 9 aa, Hepatovirus A
QMMRNEFRV

SEQ ID NO: 1164 - protein, 9 aa, Hepatovirus A
SLMDLLSSL

SEQ ID NO: 1165 - protein, 10 aa, Homo sapiens
FLENVIRDAV

SEQ ID NO: 1166 - protein, 9 aa, H5N1 subtype
FQGRGVFEL

SEQ ID NO: 1167 - protein, 10 aa, Influenza A virus
FQVDCFLWHV

SEQ ID NO: 1168 - protein, 10 aa, Artificial Sequence
  unknown
VLSPADKTNV

SEQ ID NO: 1169 - protein, 10 aa, Human adenovirus 5
LLYANSAHAL

SEQ ID NO: 1170 - protein, 9 aa, Human gammaherpesvirus 8
IGLITVLFL

SEQ ID NO: 1171 - protein, 9 aa, Human papillomavirus type 11
KVLIRCYLC

SEQ ID NO: 1172 - protein, 9 aa, Human papillomavirus type 18
NLLIRCLRC

SEQ ID NO: 1173 - protein, 9 aa, Human parvovirus 4
RMTENIVEV

SEQ ID NO: 1174 - protein, 9 aa, Human papillomavirus type 11
SIDQLCKTF

SEQ ID NO: 1175 - protein, 9 aa, Human papillomavirus type 6b
RLFENYIEL

SEQ ID NO: 1176 - protein, 9 aa, Hepatitis C virus
RLGPVQNEI

SEQ ID NO: 1177 - protein, 9 aa, Toxoplasma gondii GT1
ALAEPVTGV

SEQ ID NO: 1178 - protein, 8 aa, Plasmodium falciparum FC27/Papua New Guinea
KLVFELSA

SEQ ID NO: 1179 - protein, 9 aa, Plasmodium falciparum FC27/Papua New Guinea
TQKCEIFNV

SEQ ID NO: 1180 - protein, 9 aa, Dengue virus  2 S221
AAAWYLWEV

SEQ ID NO: 1181 - protein, 10 aa, Dengue virus 2
AIYGAAFSGV

SEQ ID NO: 1182 - protein, 10 aa, Dengue virus  2
DLMRRGDLPV

SEQ ID NO: 1183 - protein, 10 aa, Dengue virus
ELMRRGDLPV

SEQ ID NO: 1184 - protein, 10 aa, Dengue virus  2
FLEEMLRTRV

SEQ ID NO: 1185 - protein, 10 aa, Dengue virus
FLMVLLIPEP

SEQ ID NO: 1186 - protein, 9 aa, Dengue virus 2 S221
GLLTVCYVL

SEQ ID NO: 1187 - protein, 9 aa, Dengue virus 2 S221
IILEFFLIV

SEQ ID NO: 1188 - protein, 9 aa, Dengue virus
IILEFFLMV

SEQ ID NO: 1189 - protein, 10 aa, Dengue virus
IILEFFLMVL

SEQ ID NO: 1190 - protein, 9 aa, Dengue virus  2
ILLVAVSFV

SEQ ID NO: 1191 - protein, 9 aa, Dengue virus 2 S221
IMAVGMVSI

SEQ ID NO: 1192 - protein, 10 aa, Dengue virus
KVLNPYMPSV

SEQ ID NO: 1193 - protein, 9 aa, Dengue virus  2
LLILCVTQV

SEQ ID NO: 1194 - protein, 9 aa, Dengue virus  2
LLLVAHYAI

SEQ ID NO: 1195 - protein, 10 aa, Dengue virus 2 S221
LLVISGLFPV

SEQ ID NO: 1196 - protein, 10 aa, Dengue virus  2
LMGLGKGWPL

SEQ ID NO: 1197 - protein, 9 aa, Dengue virus  2
LVISGLFPV

SEQ ID NO: 1198 - protein, 10 aa, Dengue virus  2
MLLILCVTQV

SEQ ID NO: 1199 - protein, 10 aa, Dengue virus  2
MMATIGIALL

SEQ ID NO: 1200 - protein, 9 aa, Dengue virus  2
RLITVNPIV

SEQ ID NO: 1201 - protein, 10 aa, Dengue virus
SIILEFFLMV

SEQ ID NO: 1202 - protein, 10 aa, Dengue virus  2
SLLFKTEDGV

SEQ ID NO: 1203 - protein, 10 aa, Dengue virus  2
TAAAWYLWEV

SEQ ID NO: 1204 - protein, 10 aa, Dengue virus  2
TLMAMDLGEL

SEQ ID NO: 1205 - protein, 10 aa, Dengue virus  2
TLYAVATTFV

SEQ ID NO: 1206 - protein, 10 aa, Dengue virus  2
TMTDDIGMGV

SEQ ID NO: 1207 - protein, 9 aa, Dengue virus 2 S221
YLPAIVREA

SEQ ID NO: 1208 - protein, 9 aa, Dengue virus  2
YQLAVTIMA

SEQ ID NO: 1209 - protein, 9 aa, Dengue virus  2
YVVIAILTV

SEQ ID NO: 1210 - protein, 10 aa, Dengue virus  2
YVVIAILTVV

SEQ ID NO: 1211 - protein, 9 aa, Mycobacterium tuberculosis H37Rv
TLAPQVEPL

SEQ ID NO: 1212 - protein, 9 aa, Mycobacterium tuberculosis H37Rv
YLAPQWEPV

SEQ ID NO: 1213 - protein, 8 aa, Human T-lymphotropic virus 1
LFEEYTNI

SEQ ID NO: 1214 - protein, 9 aa, Human T-lymphotropic virus 1
RVLTGWGLN

SEQ ID NO: 1215 - protein, 9 aa, Homo sapiens
KLIDRTESL

SEQ ID NO: 1216 - protein, 13 aa, Homo sapiens
RLDSYVRSLPHSS

SEQ ID NO: 1217 - protein, 9 aa, Mycobacterium tuberculosis H37Rv
AILIRVRNA

SEQ ID NO: 1218 - protein, 9 aa, Mycobacterium tuberculosis H37Rv
ALLALTRAI

SEQ ID NO: 1219 - protein, 9 aa, Mycobacterium tuberculosis H37Rv
ELAAEPTEV

SEQ ID NO: 1220 - protein, 9 aa, Mycobacterium tuberculosis H37Rv
GLWLSVAAV

SEQ ID NO: 1221 - protein, 9 aa, Mycobacterium tuberculosis H37Rv
GSFVRTVSL

SEQ ID NO: 1222 - protein, 9 aa, Mycobacterium tuberculosis H37Rv
HVYAHQAQT

SEQ ID NO: 1223 - protein, 9 aa, Mycobacterium tuberculosis H37Rv
IADAALAAL

SEQ ID NO: 1224 - protein, 9 aa, Mycobacterium tuberculosis H37Rv
LTRAILIRV

SEQ ID NO: 1225 - protein, 9 aa, Mycobacterium tuberculosis H37Rv
QAQTRHPAT

SEQ ID NO: 1226 - protein, 9 aa, Mycobacterium tuberculosis H37Rv
RTVSLPVGA

SEQ ID NO: 1227 - protein, 9 aa, Trypanosoma cruzi
TLLTIDGGI

SEQ ID NO: 1228 - protein, 9 aa, Trypanosoma cruzi
TLQPVERVL

SEQ ID NO: 1229 - protein, 9 aa, Vaccinia virus
IVIEAIAEH

SEQ ID NO: 1230 - protein, 9 aa, Vaccinia virus
IVLEAIHTV

SEQ ID NO: 1231 - protein, 9 aa, Homo sapiens
YLAPENGYL

SEQ ID NO: 1232 - protein, 9 aa, Homo sapiens
AIVDKVPSV

SEQ ID NO: 1233 - protein, 9 aa, Homo sapiens
ALDDMISTL

SEQ ID NO: 1234 - protein, 9 aa, Homo sapiens
ALDPASISV

SEQ ID NO: 1235 - protein, 9 aa, Homo sapiens
ALDQEIIEV

SEQ ID NO: 1236 - protein, 9 aa, Homo sapiens
ALLDKLYAL

SEQ ID NO: 1237 - protein, 9 aa, Homo sapiens
ALLDRIVSV

SEQ ID NO: 1238 - protein, 9 aa, Homo sapiens
ALMDEVVKA

SEQ ID NO: 1239 - protein, 9 aa, Homo sapiens
ALPEDLVEV

SEQ ID NO: 1240 - protein, 9 aa, Homo sapiens
AQFEHTILL

SEQ ID NO: 1241 - protein, 9 aa, Homo sapiens
AQYEHDLEV

SEQ ID NO: 1242 - protein, 9 aa, Homo sapiens
AVDGISLHL

SEQ ID NO: 1243 - protein, 9 aa, Homo sapiens
FIIQGLRSV

SEQ ID NO: 1244 - protein, 10 aa, Homo sapiens
FIKDYPVVSI

SEQ ID NO: 1245 - protein, 11 aa, Homo sapiens
FLADPSAFVAA

SEQ ID NO: 1246 - protein, 10 aa, Homo sapiens
FLAILGGAKV

SEQ ID NO: 1247 - protein, 11 aa, Homo sapiens
FLASESLIKQI

SEQ ID NO: 1248 - protein, 9 aa, Homo sapiens
FLDENVHFF

SEQ ID NO: 1249 - protein, 9 aa, Homo sapiens
FLDEPTNHL

SEQ ID NO: 1250 - protein, 9 aa, Homo sapiens
FLDGHDLQL

SEQ ID NO: 1251 - protein, 9 aa, Homo sapiens
FLDGNEMTL

SEQ ID NO: 1252 - protein, 9 aa, Homo sapiens
FLEKLLPPV

SEQ ID NO: 1253 - protein, 9 aa, Homo sapiens
FLSELTQQL

SEQ ID NO: 1254 - protein, 10 aa, Homo sapiens
FLSELTQQLA

SEQ ID NO: 1255 - protein, 9 aa, Homo sapiens
FVDDYTVRV

SEQ ID NO: 1256 - protein, 11 aa, Homo sapiens
GLMTTVHAITA

SEQ ID NO: 1257 - protein, 9 aa, Mycobacterium tuberculosis
GLTVAVAGA

SEQ ID NO: 1258 - protein, 11 aa, Homo sapiens
GLYGIKDDVFL

SEQ ID NO: 1259 - protein, 10 aa, Homo sapiens
HLDDLKGTFA

SEQ ID NO: 1260 - protein, 9 aa, Homo sapiens
HLDEARTLL

SEQ ID NO: 1261 - protein, 9 aa, Homo sapiens
HLFETISQA

SEQ ID NO: 1262 - protein, 9 aa, Homo sapiens
ILDDIGHGV

SEQ ID NO: 1263 - protein, 9 aa, Homo sapiens
ILDPHVVLL

SEQ ID NO: 1264 - protein, 9 aa, Mycobacterium tuberculosis
ILVAGLSGC

SEQ ID NO: 1265 - protein, 9 aa, Mycobacterium tuberculosis
KITGTATGV

SEQ ID NO: 1266 - protein, 9 aa, Homo sapiens
KMDEVLYSI

SEQ ID NO: 1267 - protein, 9 aa, Homo sapiens
KMDPIISRV

SEQ ID NO: 1268 - protein, 8 aa, Homo sapiens
KMGLIFEV

SEQ ID NO: 1269 - protein, 8 aa, Homo sapiens
KVASLIGV

SEQ ID NO: 1270 - protein, 8 aa, Homo sapiens
KVIENPYL

SEQ ID NO: 1271 - protein, 9 aa, Homo sapiens
LLMSFSVCL

SEQ ID NO: 1272 - protein, 9 aa, Homo sapiens
LLPTGVFQV

SEQ ID NO: 1273 - protein, 8 aa, Homo sapiens
LMEHIHKL

SEQ ID NO: 1274 - protein, 8 aa, Homo sapiens
MKHLPGPQ

SEQ ID NO: 1275 - protein, 9 aa, Homo sapiens
NLAENISRV

SEQ ID NO: 1276 - protein, 9 aa, Homo sapiens
NLMEQPIKV

SEQ ID NO: 1277 - protein, 9 aa, Homo sapiens
RLDDSLLYL

SEQ ID NO: 1278 - protein, 10 aa, Homo sapiens
RLDELGGVYL

SEQ ID NO: 1279 - protein, 9 aa, Homo sapiens
RQFSTPFQL

SEQ ID NO: 1280 - protein, 9 aa, Homo sapiens
RVADVIAQV

SEQ ID NO: 1281 - protein, 9 aa, Bos taurus
SLDKFLANV

SEQ ID NO: 1282 - protein, 9 aa, Homo sapiens
SLEPVAVEL

SEQ ID NO: 1283 - protein, 9 aa, Homo sapiens
TEADKSTVI

SEQ ID NO: 1284 - protein, 9 aa, Homo sapiens
TLDGSLHAV

SEQ ID NO: 1285 - protein, 11 aa, Homo sapiens
TLIDLPGITRV

SEQ ID NO: 1286 - protein, 9 aa, Homo sapiens
TLIGLSIKV

SEQ ID NO: 1287 - protein, 9 aa, Homo sapiens
TLSDLRVYL

SEQ ID NO: 1288 - protein, 10 aa, Homo sapiens
TLTEEGVIKV

SEQ ID NO: 1289 - protein, 10 aa, Homo sapiens
VIDSDLDVLL

SEQ ID NO: 1290 - protein, 9 aa, Homo sapiens
VLDDKDYFL

SEQ ID NO: 1291 - protein, 9 aa, Homo sapiens
VLDDKLVFV

SEQ ID NO: 1292 - protein, 11 aa, Homo sapiens
VLFENTDSVHL

SEQ ID NO: 1293 - protein, 9 aa, Homo sapiens
VLMTEDIKL

SEQ ID NO: 1294 - protein, 11 aa, Homo sapiens
VLPGVDALSNI

SEQ ID NO: 1295 - protein, 9 aa, Homo sapiens
VMAPHEPLV

SEQ ID NO: 1296 - protein, 9 aa, Homo sapiens
YLAERIPTL

SEQ ID NO: 1297 - protein, 10 aa, Homo sapiens
YLDEDTIYHL

SEQ ID NO: 1298 - protein, 9 aa, Homo sapiens
YLDQTLPRA

SEQ ID NO: 1299 - protein, 9 aa, Homo sapiens
YLFERIKEL

SEQ ID NO: 1300 - protein, 10 aa, Bos taurus
YLGDDYVRAM

SEQ ID NO: 1301 - protein, 10 aa, Homo sapiens
YVDDTQFVRF

SEQ ID NO: 1302 - protein, 9 aa, Homo sapiens
FIDKFTPPV

SEQ ID NO: 1303 - protein, 9 aa, Homo sapiens
FLLKLTPLL

SEQ ID NO: 1304 - protein, 10 aa, Human orthopneumovirus
FLTEAIVHSV

SEQ ID NO: 1305 - protein, 9 aa, Homo sapiens
FTWEGLYNV

SEQ ID NO: 1306 - protein, 11 aa, Homo sapiens
GPFGPPMPLHV

SEQ ID NO: 1307 - protein, 8 aa, Homo sapiens
LLGPTVML

SEQ ID NO: 1308 - protein, 9 aa, Homo sapiens
LLYGFVNYI

SEQ ID NO: 1309 - protein, 9 aa, Homo sapiens
LLYGFVNYV

SEQ ID NO: 1310 - protein, 10 aa, Homo sapiens
QVFPGLLERV

SEQ ID NO: 1311 - protein, 9 aa, Human metapneumovirus
SLQQEITLL

SEQ ID NO: 1312 - protein, 9 aa, Homo sapiens
SLWGGDVVL

SEQ ID NO: 1313 - protein, 10 aa, Homo sapiens
YLDLFGDPSV

SEQ ID NO: 1314 - protein, 10 aa, Mycobacterium tuberculosis H37Rv
IMILLVLVSA

SEQ ID NO: 1315 - protein, 9 aa, Mycobacterium tuberculosis H37Rv
LILATMLVA

SEQ ID NO: 1316 - protein, 9 aa, Homo sapiens
ALADGVQKV

SEQ ID NO: 1317 - protein, 9 aa, Homo sapiens
ALKKALAAA

SEQ ID NO: 1318 - protein, 9 aa, Homo sapiens
ALNIATHVL

SEQ ID NO: 1319 - protein, 9 aa, Homo sapiens
ALSSLIHAL

SEQ ID NO: 1320 - protein, 9 aa, Homo sapiens
ALVDHVAEL

SEQ ID NO: 1321 - protein, 10 aa, Homo sapiens
AVFDKTLAEL

SEQ ID NO: 1322 - protein, 9 aa, Homo sapiens
AVIGDVIRV

SEQ ID NO: 1323 - protein, 9 aa, Homo sapiens
DLHEKDFSL

SEQ ID NO: 1324 - protein, 9 aa, Homo sapiens
ELIERIPEL

SEQ ID NO: 1325 - protein, 9 aa, Homo sapiens
FASGLIHRV

SEQ ID NO: 1326 - protein, 9 aa, Homo sapiens
FIFSDTHEL

SEQ ID NO: 1327 - protein, 11 aa, Homo sapiens
FLDASGAKLDY

SEQ ID NO: 1328 - protein, 9 aa, Homo sapiens
FLFGEVHKA

SEQ ID NO: 1329 - protein, 9 aa, Homo sapiens
FLIRESETL

SEQ ID NO: 1330 - protein, 9 aa, Homo sapiens
FLVTVIHTL

SEQ ID NO: 1331 - protein, 9 aa, Homo sapiens
FMIIPTLII

SEQ ID NO: 1332 - protein, 9 aa, Homo sapiens
FQNPFRSEL

SEQ ID NO: 1333 - protein, 11 aa, Homo sapiens
GLADASLLKKV

SEQ ID NO: 1334 - protein, 9 aa, Homo sapiens
GLIDKVNEL

SEQ ID NO: 1335 - protein, 9 aa, Homo sapiens
GQNDIHHKV

SEQ ID NO: 1336 - protein, 10 aa, Homo sapiens
GVYGGSVHEA

SEQ ID NO: 1337 - protein, 9 aa, Homo sapiens
ILAAIVNHL

SEQ ID NO: 1338 - protein, 9 aa, Homo sapiens
ILAQEIVKA

SEQ ID NO: 1339 - protein, 9 aa, Homo sapiens
ILIDPFHKA

SEQ ID NO: 1340 - protein, 9 aa, Homo sapiens
ILISKLLGA

SEQ ID NO: 1341 - protein, 9 aa, Homo sapiens
ILVKHLTNV

SEQ ID NO: 1342 - protein, 9 aa, Homo sapiens
IQIMKVEEI

SEQ ID NO: 1343 - protein, 9 aa, Homo sapiens
ITQTVIHTV

SEQ ID NO: 1344 - protein, 11 aa, Homo sapiens
IVADHVASYGV

SEQ ID NO: 1345 - protein, 9 aa, Homo sapiens
KAISGVHTV

SEQ ID NO: 1346 - protein, 9 aa, Homo sapiens
KIYEGQVEV

SEQ ID NO: 1347 - protein, 10 aa, Homo sapiens
KLFEGENEHL

SEQ ID NO: 1348 - protein, 9 aa, Homo sapiens
KLIDDVHRL

SEQ ID NO: 1349 - protein, 9 aa, Homo sapiens
KLSDLDNKL

SEQ ID NO: 1350 - protein, 10 aa, Homo sapiens
KLYDIDVAKV

SEQ ID NO: 1351 - protein, 9 aa, Homo sapiens
KMPEINAKV

SEQ ID NO: 1352 - protein, 9 aa, Homo sapiens
KTASINQNV

SEQ ID NO: 1353 - protein, 9 aa, Homo sapiens
KVGPVPVLV

SEQ ID NO: 1354 - protein, 9 aa, Homo sapiens
LLSDTVQHL

SEQ ID NO: 1355 - protein, 10 aa, Homo sapiens
MMDPNSTQRY

SEQ ID NO: 1356 - protein, 9 aa, Homo sapiens
MVPRLTAVL

SEQ ID NO: 1357 - protein, 9 aa, Homo sapiens
NIIELVHQV

SEQ ID NO: 1358 - protein, 9 aa, Dengue virus 3
NIQTAINQV

SEQ ID NO: 1359 - protein, 9 aa, Homo sapiens
NLMEMVAQL

SEQ ID NO: 1360 - protein, 9 aa, Homo sapiens
QLAQFVHEV

SEQ ID NO: 1361 - protein, 9 aa, Homo sapiens
QLVDIIEKV

SEQ ID NO: 1362 - protein, 10 aa, Homo sapiens
RLYPEGLAQL

SEQ ID NO: 1363 - protein, 10 aa, Homo sapiens
RQYPWGTVQV

SEQ ID NO: 1364 - protein, 9 aa, Homo sapiens
RVSDINFTL

SEQ ID NO: 1365 - protein, 9 aa, Homo sapiens
SAVDFIRTL

SEQ ID NO: 1366 - protein, 9 aa, Homo sapiens
SIAEVVHQL

SEQ ID NO: 1367 - protein, 9 aa, Homo sapiens
SLADIAQKL

SEQ ID NO: 1368 - protein, 9 aa, Homo sapiens
SLIRSVVAL

SEQ ID NO: 1369 - protein, 9 aa, Homo sapiens
SQFSYQHAI

SEQ ID NO: 1370 - protein, 9 aa, Homo sapiens
SQVEILQRV

SEQ ID NO: 1371 - protein, 9 aa, Homo sapiens
SVITQVFHV

SEQ ID NO: 1372 - protein, 9 aa, Homo sapiens
TIAQLVHAV

SEQ ID NO: 1373 - protein, 9 aa, Homo sapiens
TINGHNAEV

SEQ ID NO: 1374 - protein, 9 aa, Dengue virus 2 Thailand/16681/84
TITEEIAVQ

SEQ ID NO: 1375 - protein, 9 aa, Homo sapiens
TLADLVHHV

SEQ ID NO: 1376 - protein, 9 aa, Homo sapiens
TVADHIQKV

SEQ ID NO: 1377 - protein, 9 aa, Homo sapiens
TVIAKVNNV

SEQ ID NO: 1378 - protein, 9 aa, Homo sapiens
TVMGRIATL

SEQ ID NO: 1379 - protein, 10 aa, Homo sapiens
VLFEKEVNEV

SEQ ID NO: 1380 - protein, 9 aa, Homo sapiens
VLKEIVERV

SEQ ID NO: 1381 - protein, 9 aa, Homo sapiens
VQIEEVRQV

SEQ ID NO: 1382 - protein, 10 aa, Dengue virus 2
VTLLCLIPTV

SEQ ID NO: 1383 - protein, 9 aa, Homo sapiens
YAYDGKDYI

SEQ ID NO: 1384 - protein, 11 aa, Homo sapiens
YAYDGKDYIAL

SEQ ID NO: 1385 - protein, 10 aa, Homo sapiens
YIYDKDMEII

SEQ ID NO: 1386 - protein, 9 aa, Homo sapiens
YLINEIDRI

SEQ ID NO: 1387 - protein, 9 aa, Homo sapiens
YLKDLIEEV

SEQ ID NO: 1388 - protein, 9 aa, Homo sapiens
YMAELIERL

SEQ ID NO: 1389 - protein, 9 aa, Homo sapiens
YMIAHITGL

SEQ ID NO: 1390 - protein, 9 aa, Homo sapiens
YTFPLAEKV

SEQ ID NO: 1391 - protein, 9 aa, Homo sapiens
YVKDRVEKV

SEQ ID NO: 1392 - protein, 9 aa, Hantaan orthohantavirus
FVVPILLKA

SEQ ID NO: 1393 - protein, 9 aa, H5N1 subtype
QLSTRGVQI

SEQ ID NO: 1394 - protein, 9 aa, Hantaan orthohantavirus
VPILLKALY

SEQ ID NO: 1395 - protein, 9 aa, Herpes simplex virus (type 1 / strain 17)
RMLGDVMAV

SEQ ID NO: 1396 - protein, 9 aa, Herpes simplex virus (type 1 / strain 17)
TMLEDHEFV

SEQ ID NO: 1397 - protein, 9 aa, Homo sapiens
ALAVLSVTL

SEQ ID NO: 1398 - protein, 9 aa, Homo sapiens
ALSEDLLSI

SEQ ID NO: 1399 - protein, 9 aa, Homo sapiens
GLLDQVAAL

SEQ ID NO: 1400 - protein, 9 aa, Homo sapiens
GLREDLLSL

SEQ ID NO: 1401 - protein, 9 aa, Homo sapiens
LLIGGFAGL

SEQ ID NO: 1402 - protein, 10 aa, Homo sapiens
SLQDVPLAAL

SEQ ID NO: 1403 - protein, 9 aa, Homo sapiens
ATYVFLHTV

SEQ ID NO: 1404 - protein, 9 aa, Homo sapiens
SLSTFQQMW

SEQ ID NO: 1405 - protein, 9 aa, Homo sapiens
STLHLVLRL

SEQ ID NO: 1406 - protein, 9 aa, Homo sapiens
QLSLLMWIT

SEQ ID NO: 1407 - protein, 9 aa, Human gammaherpesvirus 4
ALGGLLTMV

SEQ ID NO: 1408 - protein, 9 aa, Human gammaherpesvirus 4
CLGALLTMV

SEQ ID NO: 1409 - protein, 9 aa, Human gammaherpesvirus 4
CLGGLATMV

SEQ ID NO: 1410 - protein, 9 aa, Human gammaherpesvirus 4
CLGGLLAMV

SEQ ID NO: 1411 - protein, 9 aa, Homo sapiens
ALGDLFQSI

SEQ ID NO: 1412 - protein, 10 aa, Homo sapiens
AVAANIVLTV

SEQ ID NO: 1413 - protein, 10 aa, Trypanosoma cruzi
AVPEVTDVTL

SEQ ID NO: 1414 - protein, 9 aa, Trypanosoma cruzi
DIIEQMKGV

SEQ ID NO: 1415 - protein, 9 aa, Homo sapiens
DLTSFLLSL

SEQ ID NO: 1416 - protein, 9 aa, Homo sapiens
EILGALLSI

SEQ ID NO: 1417 - protein, 10 aa, Homo sapiens
FLLSLFSLWL

SEQ ID NO: 1418 - protein, 10 aa, Trypanosoma cruzi
FVSCCGELTV

SEQ ID NO: 1419 - protein, 9 aa, Trypanosoma cruzi
GVSGVINAL

SEQ ID NO: 1420 - protein, 9 aa, Homo sapiens
HIAGSLAVV

SEQ ID NO: 1421 - protein, 10 aa, Homo sapiens
ILAVDGVLSV

SEQ ID NO: 1422 - protein, 9 aa, Homo sapiens
ILGALLSIL

SEQ ID NO: 1423 - protein, 9 aa, Homo sapiens
ILKDFSILL

SEQ ID NO: 1424 - protein, 9 aa, Homo sapiens
ILSAHVATA

SEQ ID NO: 1425 - protein, 10 aa, Homo sapiens
ILVLASTITI

SEQ ID NO: 1426 - protein, 9 aa, Trypanosoma cruzi
KLEKIEDEL

SEQ ID NO: 1427 - protein, 9 aa, Homo sapiens
LLIDLTSFL

SEQ ID NO: 1428 - protein, 10 aa, Homo sapiens
LLMEGVPKSL

SEQ ID NO: 1429 - protein, 9 aa, Trypanosoma cruzi
RLYKTLGQL

SEQ ID NO: 1430 - protein, 9 aa, Homo sapiens
SISVLISAL

SEQ ID NO: 1431 - protein, 10 aa, Homo sapiens
SLNYSGVKEL

SEQ ID NO: 1432 - protein, 10 aa, Homo sapiens
SVHSLHIWSL

SEQ ID NO: 1433 - protein, 9 aa, Homo sapiens
VVTGVLVYL

SEQ ID NO: 1434 - protein, 9 aa, Homo sapiens
ALLKDTVYT

SEQ ID NO: 1435 - protein, 9 aa, Homo sapiens
FIFSILVLA

SEQ ID NO: 1436 - protein, 9 aa, Homo sapiens
IQATVMIIV

SEQ ID NO: 1437 - protein, 9 aa, Homo sapiens
KMYAFTLES

SEQ ID NO: 1438 - protein, 9 aa, Homo sapiens
KSLNYSGVK

SEQ ID NO: 1439 - protein, 9 aa, Homo sapiens
LAVDGVLSV

SEQ ID NO: 1440 - protein, 9 aa, Homo sapiens
LLSILCIWV

SEQ ID NO: 1441 - protein, 9 aa, Homo sapiens
LLSLFSLWL

SEQ ID NO: 1442 - protein, 9 aa, Homo sapiens
MLLDKNIPI

SEQ ID NO: 1443 - protein, 9 aa, Homo sapiens
RLLYPDYQI

SEQ ID NO: 1444 - protein, 9 aa, Homo sapiens
TMHSLTIQM

SEQ ID NO: 1445 - protein, 9 aa, Homo sapiens
VAANIVLTV

SEQ ID NO: 1446 - protein, 8 aa, Homo sapiens
VLHDDLLE

SEQ ID NO: 1447 - protein, 9 aa, Mycobacterium tuberculosis H37Rv
LIASNVAGV

SEQ ID NO: 1448 - protein, 9 aa, Human T-lymphotropic virus 1
GLLSLEEEL

SEQ ID NO: 1449 - protein, 10 aa, Homo sapiens
FATGIGIITV

SEQ ID NO: 1450 - protein, 10 aa, Homo sapiens
FLTGIGIITV

SEQ ID NO: 1451 - protein, 9 aa, Homo sapiens
KAMELIREL

SEQ ID NO: 1452 - protein, 10 aa, Homo sapiens
KISRETGEKL

SEQ ID NO: 1453 - protein, 9 aa, Homo sapiens
KTLERSYLL

SEQ ID NO: 1454 - protein, 9 aa, Homo sapiens
KVIEINPYL

SEQ ID NO: 1455 - protein, 9 aa, Homo sapiens
RTVEKTWKL

SEQ ID NO: 1456 - protein, 9 aa, Homo sapiens
TVAPFNPTV

SEQ ID NO: 1457 - protein, 9 aa, Homo sapiens
VTTDIQVKV

SEQ ID NO: 1458 - protein, 9 aa, Human herpesvirus 6 strain Z29
GILDFGVKL

SEQ ID NO: 1459 - protein, 9 aa, Human herpesvirus 6 strain Z29
ILYGPLTRI

SEQ ID NO: 1460 - protein, 9 aa, Human herpesvirus 6 strain Z29
LLCGNLLIL

SEQ ID NO: 1461 - protein, 9 aa, Human herpesvirus 6 strain Z29
MLWYTVYNI

SEQ ID NO: 1462 - protein, 9 aa, Influenza A virus (A/mallard/Quebec/10969/2006(H2N3))
MTIIFLILM

SEQ ID NO: 1463 - protein, 11 aa, Influenza A virus (A/Yokohama/22/2002(H1N2))
PVAGGTSSIYI

SEQ ID NO: 1464 - protein, 9 aa, Human herpesvirus 6 strain Z29
SLMSGVEPL

SEQ ID NO: 1465 - protein, 8 aa, Influenza A virus  (A/duck/Vietnam/37/2007(H5N1))
TVIKTNMI

SEQ ID NO: 1466 - protein, 9 aa, Influenza A virus (A/Memphis/10/1996(H1N1))
YINTALLNA

SEQ ID NO: 1467 - protein, 9 aa, Influenza A virus
GILGFVTTL

SEQ ID NO: 1468 - protein, 10 aa, Homo sapiens
ALWGPDPAAV

SEQ ID NO: 1469 - protein, 10 aa, Homo sapiens
AQWGPDPAAV

SEQ ID NO: 1470 - protein, 10 aa, Homo sapiens
RQWGPDPAAV

SEQ ID NO: 1471 - protein, 10 aa, Hepatitis B virus
FLGPLLVLQA

SEQ ID NO: 1472 - protein, 9 aa, Hepatitis C virus genotype 1
WLGNIIMYA

SEQ ID NO: 1473 - protein, 11 aa, Homo sapiens
FFAGGIGIRTI

SEQ ID NO: 1474 - protein, 11 aa, Homo sapiens
FLAGGIGIRTL

SEQ ID NO: 1475 - protein, 9 aa, Homo sapiens
FWLLGAWAL

SEQ ID NO: 1476 - protein, 9 aa, Homo sapiens
FWLLPAWAL

SEQ ID NO: 1477 - protein, 9 aa, Homo sapiens
ILAKFLHWL

SEQ ID NO: 1478 - protein, 8 aa, Homo sapiens
WLLPAWGV

SEQ ID NO: 1479 - protein, 8 aa, Homo sapiens
WLLPTWGV

SEQ ID NO: 1480 - protein, 9 aa, Human immunodeficiency virus 1
SLFNAVATL

SEQ ID NO: 1481 - protein, 9 aa, Human immunodeficiency virus 1
SLFNTIATL

SEQ ID NO: 1482 - protein, 9 aa, Human immunodeficiency virus 1
SLFNTVATV

SEQ ID NO: 1483 - protein, 9 aa, Human immunodeficiency virus 1
SLFNTVAVL

SEQ ID NO: 1484 - protein, 9 aa, Human immunodeficiency virus 1
SLFNTVVTL

SEQ ID NO: 1485 - protein, 9 aa, Yellow fever virus 17D
AMDTISVFL

SEQ ID NO: 1486 - protein, 9 aa, Yellow fever virus 17D
VMLFILAGL

SEQ ID NO: 1487 - protein, 10 aa, Dengue virus
CLMMMLPATL

SEQ ID NO: 1488 - protein, 10 aa, Dengue virus
FTMGVLCLAI

SEQ ID NO: 1489 - protein, 10 aa, Dengue virus
ITLLCLIPTV

SEQ ID NO: 1490 - protein, 10 aa, Dengue virus
LMLLALIAVL

SEQ ID NO: 1491 - protein, 9 aa, Dengue virus
LMMMLPATL

SEQ ID NO: 1492 - protein, 10 aa, Dengue virus
LMMMLPATLA

SEQ ID NO: 1493 - protein, 9 aa, Dengue virus
MMMLPATLA

SEQ ID NO: 1494 - protein, 9 aa, Homo sapiens
QLLNSVLTL

SEQ ID NO: 1495 - protein, 9 aa, Dengue virus
TLLCLIPTV

SEQ ID NO: 1496 - protein, 10 aa, Dengue virus
TLMLLALIAV

SEQ ID NO: 1497 - protein, 10 aa, Dengue virus
TLTAAVLLLV

SEQ ID NO: 1498 - protein, 10 aa, Dengue virus
VLLLVTHYAI

SEQ ID NO: 1499 - protein, 9 aa, Dengue virus
VTYECPLLV

SEQ ID NO: 1500 - protein, 9 aa, Human herpesvirus 4 strain B95-8
SLGGLLTMA

SEQ ID NO: 1501 - protein, 9 aa, Rift Valley fever virus
ILDAHSLYL

SEQ ID NO: 1502 - protein, 9 aa, Rift Valley fever virus
VLSEWLPVT

SEQ ID NO: 1503 - protein, 9 aa, Homo sapiens
GLVPFLVSV

SEQ ID NO: 1504 - protein, 9 aa, Influenza A virus (A/Netherlands/602/2009(H1N1))
AIMEKNIVL

SEQ ID NO: 1505 - protein, 9 aa, Influenza A virus (A/Netherlands/602/2009(H1N1))
AVMEKNIVL

SEQ ID NO: 1506 - protein, 9 aa, Dengue virus
ALPVYLMTL

SEQ ID NO: 1507 - protein, 9 aa, Dengue virus
ALSEGVYRI

SEQ ID NO: 1508 - protein, 10 aa, Dengue virus
GLFGKTQVGV

SEQ ID NO: 1509 - protein, 9 aa, Dengue virus 3
KLNDWDFVV

SEQ ID NO: 1510 - protein, 9 aa, Dengue virus
KLTDWDFVV

SEQ ID NO: 1511 - protein, 9 aa, Human T-lymphotropic virus 1
LLFGFPVYV

SEQ ID NO: 1512 - protein, 9 aa, Dengue virus 3
SMINGVVKL

SEQ ID NO: 1513 - protein, 9 aa, Dengue virus 3
TTWEDVPYL

SEQ ID NO: 1514 - protein, 9 aa, Dengue virus  1
VLDDGIYRI

SEQ ID NO: 1515 - protein, 13 aa, Human T-lymphotropic virus 1
LLFGFAVYVSCMF

SEQ ID NO: 1516 - protein, 13 aa, Human T-lymphotropic virus 1
LLFGFPVFVSCMF

SEQ ID NO: 1517 - protein, 9 aa, Human T-lymphotropic virus 1
LLFGYPVFV

SEQ ID NO: 1518 - protein, 9 aa, Hepatitis B virus
VCWGELMNL

SEQ ID NO: 1519 - protein, 9 aa, Human rotavirus A
FLDSEPHLL

SEQ ID NO: 1520 - protein, 9 aa, Human betaherpesvirus 5
SLISGMWLL

SEQ ID NO: 1521 - protein, 11 aa, Human rotavirus A
SLMDPAILTSL

SEQ ID NO: 1522 - protein, 8 aa, Human rotavirus A
YLLPGWKL

SEQ ID NO: 1523 - protein, 9 aa, Vaccinia virus Copenhagen
DIDEILEKV

SEQ ID NO: 1524 - protein, 9 aa, Vaccinia virus Copenhagen
DIEIVKLLL

SEQ ID NO: 1525 - protein, 9 aa, Vaccinia virus Copenhagen
DVYVKIDNV

SEQ ID NO: 1526 - protein, 9 aa, Vaccinia virus WR
EIINNITAV

SEQ ID NO: 1527 - protein, 9 aa, Vaccinia virus Copenhagen
ELLNILTEL

SEQ ID NO: 1528 - protein, 9 aa, Vaccinia virus Copenhagen
EVNKALYDL

SEQ ID NO: 1529 - protein, 9 aa, Vaccinia virus WR
FVEPEELNL

SEQ ID NO: 1530 - protein, 9 aa, Vaccinia virus Copenhagen
ILMRHLKNL

SEQ ID NO: 1531 - protein, 9 aa, Vaccinia virus WR
KIDDMIEEV

SEQ ID NO: 1532 - protein, 9 aa, Vaccinia virus Copenhagen
KIGPPTVTL

SEQ ID NO: 1533 - protein, 9 aa, Vaccinia virus WR
KIIQRVQDL

SEQ ID NO: 1534 - protein, 10 aa, Vaccinia virus WR
KIRSDNIKKL

SEQ ID NO: 1535 - protein, 9 aa, Vaccinia virus WR
KLTELNAEL

SEQ ID NO: 1536 - protein, 9 aa, Vaccinia virus Copenhagen
KVLDIDEIL

SEQ ID NO: 1537 - protein, 9 aa, Vaccinia virus Copenhagen
KVVKLTPQV

SEQ ID NO: 1538 - protein, 9 aa, Vaccinia virus WR
LILDPKINV

SEQ ID NO: 1539 - protein, 9 aa, Vaccinia virus Copenhagen
MIKPCCERV

SEQ ID NO: 1540 - protein, 10 aa, Vaccinia virus WR
PLALYSADKV

SEQ ID NO: 1541 - protein, 9 aa, Vaccinia virus Copenhagen
QIDVEKKIV

SEQ ID NO: 1542 - protein, 9 aa, Vaccinia virus WR
QVSIIQEKL

SEQ ID NO: 1543 - protein, 10 aa, Vaccinia virus Copenhagen
SIHTIKTLGV

SEQ ID NO: 1544 - protein, 10 aa, Vaccinia virus Copenhagen
SIIFGRQPSL

SEQ ID NO: 1545 - protein, 9 aa, Vaccinia virus Copenhagen
TIEELKQKL

SEQ ID NO: 1546 - protein, 9 aa, Vaccinia virus Copenhagen
TIINKFFEV

SEQ ID NO: 1547 - protein, 9 aa, Vaccinia virus Copenhagen
TINDLKMML

SEQ ID NO: 1548 - protein, 10 aa, Vaccinia virus Copenhagen
TLIGNFAAHL

SEQ ID NO: 1549 - protein, 9 aa, Vaccinia virus WR
TLRVLQDQL

SEQ ID NO: 1550 - protein, 9 aa, Vaccinia virus Copenhagen
TVMINNVKL

SEQ ID NO: 1551 - protein, 9 aa, Vaccinia virus Copenhagen
TVYDINNEV

SEQ ID NO: 1552 - protein, 9 aa, Vaccinia virus WR
VLESCWPDV

SEQ ID NO: 1553 - protein, 9 aa, Vaccinia virus Copenhagen
VLISPVSIL

SEQ ID NO: 1554 - protein, 9 aa, Vaccinia virus Copenhagen
VLNDQYAKV

SEQ ID NO: 1555 - protein, 10 aa, Vaccinia virus WR
YILNSLTKGL

SEQ ID NO: 1556 - protein, 9 aa, Vaccinia virus Copenhagen
YINNNIEEI

SEQ ID NO: 1557 - protein, 9 aa, Vaccinia virus Copenhagen
YITNRLELL

SEQ ID NO: 1558 - protein, 10 aa, Vaccinia virus Copenhagen
YLLDRGADIV

SEQ ID NO: 1559 - protein, 9 aa, Human immunodeficiency virus 1
ALYNTVATL

SEQ ID NO: 1560 - protein, 9 aa, Human immunodeficiency virus 1
SLFNAVAVL

SEQ ID NO: 1561 - protein, 9 aa, Human immunodeficiency virus 1
SLFNTIAVL

SEQ ID NO: 1562 - protein, 9 aa, Human immunodeficiency virus 1
SLYLTVATL

SEQ ID NO: 1563 - protein, 9 aa, Human immunodeficiency virus 1
SLYNSVATL

SEQ ID NO: 1564 - protein, 9 aa, Human immunodeficiency virus 1
SLYNTAATL

SEQ ID NO: 1565 - protein, 9 aa, Human immunodeficiency virus 1
SLYNTIAIL

SEQ ID NO: 1566 - protein, 9 aa, Human immunodeficiency virus 1
SLYNTIATL

SEQ ID NO: 1567 - protein, 9 aa, Human immunodeficiency virus 1
SLYNTISVL

SEQ ID NO: 1568 - protein, 9 aa, Human immunodeficiency virus 1
SLYNTITVL

SEQ ID NO: 1569 - protein, 9 aa, Human immunodeficiency virus 1
SLYNTVAAL

SEQ ID NO: 1570 - protein, 9 aa, Human immunodeficiency virus 1
SLYNTVAIF

SEQ ID NO: 1571 - protein, 9 aa, Human immunodeficiency virus 1
SLYNTVAVL

SEQ ID NO: 1572 - protein, 9 aa, Human immunodeficiency virus 1
SLYNTVSTL

SEQ ID NO: 1573 - protein, 9 aa, Human immunodeficiency virus 1
SLYNTVVTL

SEQ ID NO: 1574 - protein, 9 aa, Human immunodeficiency virus 1
SLYQTVATL

SEQ ID NO: 1575 - protein, 9 aa, Human immunodeficiency virus 1
SVYNTVATL

SEQ ID NO: 1576 - protein, 9 aa, Mycobacterium tuberculosis
ALADLPVTV

SEQ ID NO: 1577 - protein, 9 aa, Mycobacterium tuberculosis
AMLDHAGDM

SEQ ID NO: 1578 - protein, 9 aa, Mycobacterium tuberculosis
SIIIPTLNV

SEQ ID NO: 1579 - protein, 9 aa, Mycobacterium tuberculosis
VLAGSVDEL

SEQ ID NO: 1580 - protein, 10 aa, Homo sapiens
ALAGIGILTV

SEQ ID NO: 1581 - protein, 10 aa, Homo sapiens
ELAAIGILTV

SEQ ID NO: 1582 - protein, 10 aa, Homo sapiens
ELAGIAILTV

SEQ ID NO: 1583 - protein, 10 aa, Homo sapiens
ELAGIGALTV

SEQ ID NO: 1584 - protein, 10 aa, Homo sapiens
ELAGIGIATV

SEQ ID NO: 1585 - protein, 10 aa, Homo sapiens
ELAGIGILAV

SEQ ID NO: 1586 - protein, 10 aa, Hepatitis C virus
KLLGLGINAV

SEQ ID NO: 1587 - protein, 10 aa, Hepatitis C virus
KLSGLGINAI

SEQ ID NO: 1588 - protein, 10 aa, Human immunodeficiency virus 1
KSLFNTIATL

SEQ ID NO: 1589 - protein, 10 aa, Human immunodeficiency virus 1
KSLYNTIATL

SEQ ID NO: 1590 - protein, 10 aa, Human immunodeficiency virus 1
KSLYNTIAVL

SEQ ID NO: 1591 - protein, 10 aa, Human immunodeficiency virus 1
KSLYNTVAVL

SEQ ID NO: 1592 - protein, 10 aa, Human immunodeficiency virus 1
RSLFNTIATL

SEQ ID NO: 1593 - protein, 10 aa, Human immunodeficiency virus 1
RSLFNTIAVL

SEQ ID NO: 1594 - protein, 10 aa, Human immunodeficiency virus 1
RSLFNTVAVL

SEQ ID NO: 1595 - protein, 10 aa, Human immunodeficiency virus 1
RSLYNTIATL

SEQ ID NO: 1596 - protein, 10 aa, Human immunodeficiency virus 1
RSLYNTIAVL

SEQ ID NO: 1597 - protein, 10 aa, Human immunodeficiency virus 1
SLFNTIATLY

SEQ ID NO: 1598 - protein, 10 aa, Human immunodeficiency virus 1
SLFNTVAVLY

SEQ ID NO: 1599 - protein, 10 aa, Human immunodeficiency virus 1
SLYNTIATLY

SEQ ID NO: 1600 - protein, 10 aa, Human immunodeficiency virus 1
SLYNTIAVLY

SEQ ID NO: 1601 - protein, 10 aa, Human immunodeficiency virus 1
SLYNTVATLY

SEQ ID NO: 1602 - protein, 10 aa, Human immunodeficiency virus 1
SLYNTVAVLY

SEQ ID NO: 1603 - protein, 9 aa, Homo sapiens
KLGPAGTTI

SEQ ID NO: 1604 - protein, 10 aa, Homo sapiens
RVAPEEHPVL

SEQ ID NO: 1605 - protein, 9 aa, Homo sapiens
RYLEQLHQL

SEQ ID NO: 1606 - protein, 11 aa, Homo sapiens
YQFDKVGILTL

SEQ ID NO: 1607 - protein, 12 aa, Homo sapiens
AIKKKDELERVA

SEQ ID NO: 1608 - protein, 10 aa, Homo sapiens
AILETAPKEV

SEQ ID NO: 1609 - protein, 9 aa, Homo sapiens
AILTVVPKI

SEQ ID NO: 1610 - protein, 9 aa, Homo sapiens
AIVRSLPSV

SEQ ID NO: 1611 - protein, 9 aa, Homo sapiens
ALAAALAHI

SEQ ID NO: 1612 - protein, 9 aa, Homo sapiens
ALAALHVTL

SEQ ID NO: 1613 - protein, 11 aa, Homo sapiens
ALADKELLPSV

SEQ ID NO: 1614 - protein, 10 aa, Homo sapiens
ALAEIAKAEL

SEQ ID NO: 1615 - protein, 12 aa, Homo sapiens
ALAGHQDGITFI

SEQ ID NO: 1616 - protein, 9 aa, Homo sapiens
ALAKEIDSV

SEQ ID NO: 1617 - protein, 9 aa, Homo sapiens
ALAKLVEAI

SEQ ID NO: 1618 - protein, 9 aa, Homo sapiens
ALANHLIKV

SEQ ID NO: 1619 - protein, 9 aa, Homo sapiens
ALAQRLLEV

SEQ ID NO: 1620 - protein, 9 aa, Homo sapiens
ALATLIHQV

SEQ ID NO: 1621 - protein, 9 aa, Homo sapiens
ALDEYNMKI

SEQ ID NO: 1622 - protein, 9 aa, Homo sapiens
ALDKALTSV

SEQ ID NO: 1623 - protein, 10 aa, Homo sapiens
ALDPASLPRV

SEQ ID NO: 1624 - protein, 9 aa, Homo sapiens
ALDSQVPKV

SEQ ID NO: 1625 - protein, 9 aa, Homo sapiens
ALEEKIPNI

SEQ ID NO: 1626 - protein, 12 aa, Homo sapiens
ALFDQDKSSMRL

SEQ ID NO: 1627 - protein, 10 aa, Homo sapiens
ALFDSGLHPA

SEQ ID NO: 1628 - protein, 9 aa, Homo sapiens
ALFEGKVQL

SEQ ID NO: 1629 - protein, 8 aa, Homo sapiens
ALFKAWAL

SEQ ID NO: 1630 - protein, 10 aa, Homo sapiens
ALFQPHLINV

SEQ ID NO: 1631 - protein, 9 aa, Homo sapiens
ALFQRPPLI

SEQ ID NO: 1632 - protein, 11 aa, Homo sapiens
ALGAGIERMGL

SEQ ID NO: 1633 - protein, 9 aa, Homo sapiens
ALGPTGRGV

SEQ ID NO: 1634 - protein, 11 aa, Homo sapiens
ALGTDAEGQKV

SEQ ID NO: 1635 - protein, 9 aa, Homo sapiens
ALIARVTNV

SEQ ID NO: 1636 - protein, 9 aa, Homo sapiens
ALIDRMVNL

SEQ ID NO: 1637 - protein, 11 aa, Homo sapiens
ALIEAEKVAQV

SEQ ID NO: 1638 - protein, 9 aa, Homo sapiens
ALIEKLVEL

SEQ ID NO: 1639 - protein, 9 aa, Homo sapiens
ALITRIFGV

SEQ ID NO: 1640 - protein, 9 aa, Homo sapiens
ALKDLINEA

SEQ ID NO: 1641 - protein, 10 aa, Homo sapiens
ALLAGPLRPA

SEQ ID NO: 1642 - protein, 11 aa, Homo sapiens
ALLAGSEYLKL

SEQ ID NO: 1643 - protein, 10 aa, Homo sapiens
ALLDGRLQVV

SEQ ID NO: 1644 - protein, 9 aa, Homo sapiens
ALLDSAHLL

SEQ ID NO: 1645 - protein, 12 aa, Homo sapiens
ALLEDEERVVRL

SEQ ID NO: 1646 - protein, 9 aa, Homo sapiens
ALLEMDARL

SEQ ID NO: 1647 - protein, 9 aa, Homo sapiens
ALLGDLTKA

SEQ ID NO: 1648 - protein, 9 aa, Homo sapiens
ALLGILQHV

SEQ ID NO: 1649 - protein, 9 aa, Herpes simplex virus (type 1 / strain 17)
ALLGLTLGV

SEQ ID NO: 1650 - protein, 9 aa, Homo sapiens
ALLGRIPSA

SEQ ID NO: 1651 - protein, 9 aa, Homo sapiens
ALLKGLAAV

SEQ ID NO: 1652 - protein, 8 aa, Homo sapiens
ALLKQVEI

SEQ ID NO: 1653 - protein, 9 aa, Homo sapiens
ALLQQVHSA

SEQ ID NO: 1654 - protein, 9 aa, Homo sapiens
ALLSGLREA

SEQ ID NO: 1655 - protein, 12 aa, Homo sapiens
ALMDLDVKKMPL

SEQ ID NO: 1656 - protein, 11 aa, Homo sapiens
ALMEQVAHQTI

SEQ ID NO: 1657 - protein, 9 aa, Homo sapiens
ALMSRPAQV

SEQ ID NO: 1658 - protein, 11 aa, Homo sapiens
ALNEEAGRLLL

SEQ ID NO: 1659 - protein, 9 aa, Homo sapiens
ALNELLQHV

SEQ ID NO: 1660 - protein, 9 aa, Homo sapiens
ALNEQIARL

SEQ ID NO: 1661 - protein, 9 aa, Homo sapiens
ALNGKLYIV

SEQ ID NO: 1662 - protein, 9 aa, Homo sapiens
ALQEKLWNV

SEQ ID NO: 1663 - protein, 9 aa, Homo sapiens
ALQEKVQAV

SEQ ID NO: 1664 - protein, 9 aa, Homo sapiens
ALQEMVHQV

SEQ ID NO: 1665 - protein, 9 aa, Homo sapiens
ALQSLIPSL

SEQ ID NO: 1666 - protein, 9 aa, Homo sapiens
ALRDVSEEL

SEQ ID NO: 1667 - protein, 9 aa, Homo sapiens
ALREENEQL

SEQ ID NO: 1668 - protein, 9 aa, Homo sapiens
ALRGEIETV

SEQ ID NO: 1669 - protein, 9 aa, Homo sapiens
ALSEKLARL

SEQ ID NO: 1670 - protein, 10 aa, Homo sapiens
ALSKEGIVAL

SEQ ID NO: 1671 - protein, 9 aa, Homo sapiens
ALSNLEVKL

SEQ ID NO: 1672 - protein, 9 aa, Homo sapiens
ALTRLHITV

SEQ ID NO: 1673 - protein, 10 aa, Homo sapiens
ALVDHLNVGV

SEQ ID NO: 1674 - protein, 9 aa, Homo sapiens
ALVSSLHLL

SEQ ID NO: 1675 - protein, 10 aa, Homo sapiens
ALWEDEGVRA

SEQ ID NO: 1676 - protein, 9 aa, Homo sapiens
ALWEGPSKA

SEQ ID NO: 1677 - protein, 11 aa, Homo sapiens
ALWSVGGEVHV

SEQ ID NO: 1678 - protein, 9 aa, Homo sapiens
ALYASRLYL

SEQ ID NO: 1679 - protein, 9 aa, Homo sapiens
ALYDEVRTV

SEQ ID NO: 1680 - protein, 9 aa, Homo sapiens
ALYDNVEKL

SEQ ID NO: 1681 - protein, 9 aa, Homo sapiens
ALYGKLLKL

SEQ ID NO: 1682 - protein, 11 aa, Homo sapiens
ALYGRAEAAEV

SEQ ID NO: 1683 - protein, 9 aa, Homo sapiens
ALYHLAIKL

SEQ ID NO: 1684 - protein, 11 aa, Homo sapiens
ALYNDISHMKI

SEQ ID NO: 1685 - protein, 10 aa, Homo sapiens
AMAQEGLREV

SEQ ID NO: 1686 - protein, 10 aa, Homo sapiens
AMFDHIPVGV

SEQ ID NO: 1687 - protein, 9 aa, Homo sapiens
AMFGKLMTI

SEQ ID NO: 1688 - protein, 9 aa, Homo sapiens
AMLAVLHTV

SEQ ID NO: 1689 - protein, 11 aa, Homo sapiens
AMLENASDIKL

SEQ ID NO: 1690 - protein, 9 aa, Homo sapiens
AMLTVLHEI

SEQ ID NO: 1691 - protein, 9 aa, Homo sapiens
AMNGHVPAV

SEQ ID NO: 1692 - protein, 9 aa, Homo sapiens
AMWEHPITA

SEQ ID NO: 1693 - protein, 9 aa, Homo sapiens
AMYEHKIFV

SEQ ID NO: 1694 - protein, 9 aa, Homo sapiens
ATIQRIPEV

SEQ ID NO: 1695 - protein, 10 aa, Homo sapiens
AVIDVGINRV

SEQ ID NO: 1696 - protein, 12 aa, Homo sapiens
AVTKTAGPIASA

SEQ ID NO: 1697 - protein, 9 aa, Homo sapiens
DLKDQIQDV

SEQ ID NO: 1698 - protein, 10 aa, Homo sapiens
DVIRHGADAV

SEQ ID NO: 1699 - protein, 9 aa, Homo sapiens
EITNVTQKI

SEQ ID NO: 1700 - protein, 9 aa, Homo sapiens
EMEKKLKEI

SEQ ID NO: 1701 - protein, 9 aa, Homo sapiens
FASHVSPEV

SEQ ID NO: 1702 - protein, 10 aa, Homo sapiens
FIFDVHVHEV

SEQ ID NO: 1703 - protein, 10 aa, Homo sapiens
FIFEKKLAQA

SEQ ID NO: 1704 - protein, 10 aa, Homo sapiens
FIFSEKPVFV

SEQ ID NO: 1705 - protein, 10 aa, Homo sapiens
FIIEKQPPQV

SEQ ID NO: 1706 - protein, 9 aa, Homo sapiens
FIINGIEKV

SEQ ID NO: 1707 - protein, 10 aa, Homo sapiens
FIMEGPLTRI

SEQ ID NO: 1708 - protein, 10 aa, Homo sapiens
FIMEGTLTRV

SEQ ID NO: 1709 - protein, 9 aa, Homo sapiens
FINARNWTL

SEQ ID NO: 1710 - protein, 9 aa, Homo sapiens
FINIVVHSV

SEQ ID NO: 1711 - protein, 9 aa, Homo sapiens
FIQEIEHAL

SEQ ID NO: 1712 - protein, 9 aa, Homo sapiens
FISEFEHRV

SEQ ID NO: 1713 - protein, 9 aa, Homo sapiens
FIWENIHTL

SEQ ID NO: 1714 - protein, 10 aa, Homo sapiens
FIYHGEVPQA

SEQ ID NO: 1715 - protein, 10 aa, Homo sapiens
FLADVDKLKL

SEQ ID NO: 1716 - protein, 10 aa, Homo sapiens
FLAEDPKVTL

SEQ ID NO: 1717 - protein, 9 aa, Homo sapiens
FLAEHDYGL

SEQ ID NO: 1718 - protein, 10 aa, Homo sapiens
FLAEHPNVTL

SEQ ID NO: 1719 - protein, 11 aa, Homo sapiens
FLAHDQAVRTL

SEQ ID NO: 1720 - protein, 9 aa, Homo sapiens
FLANIGTSV

SEQ ID NO: 1721 - protein, 9 aa, Homo sapiens
FLAVKPDGV

SEQ ID NO: 1722 - protein, 9 aa, Homo sapiens
FLAVRVQQV

SEQ ID NO: 1723 - protein, 9 aa, Homo sapiens
FLDASGAKL

SEQ ID NO: 1724 - protein, 9 aa, Homo sapiens
FLDDVVHSL

SEQ ID NO: 1725 - protein, 9 aa, Homo sapiens
FLDENVHFA

SEQ ID NO: 1726 - protein, 9 aa, Homo sapiens
FLDHIIASV

SEQ ID NO: 1727 - protein, 9 aa, Homo sapiens
FLDIHNIHV

SEQ ID NO: 1728 - protein, 9 aa, Homo sapiens
FLDITNPKA

SEQ ID NO: 1729 - protein, 9 aa, Homo sapiens
FLDKNDHSL

SEQ ID NO: 1730 - protein, 9 aa, Homo sapiens
FLDKQGFYV

SEQ ID NO: 1731 - protein, 9 aa, Homo sapiens
FLDNERHEV

SEQ ID NO: 1732 - protein, 11 aa, Homo sapiens
FLDPGGPMMKL

SEQ ID NO: 1733 - protein, 10 aa, Homo sapiens
FLDPNNIPKA

SEQ ID NO: 1734 - protein, 9 aa, Homo sapiens
FLDPRPLTV

SEQ ID NO: 1735 - protein, 10 aa, Homo sapiens
FLDPRPLTVV

SEQ ID NO: 1736 - protein, 9 aa, Homo sapiens
FLDQHGHNL

SEQ ID NO: 1737 - protein, 10 aa, Homo sapiens
FLDSGTIRGV

SEQ ID NO: 1738 - protein, 9 aa, Homo sapiens
FLDVNSHKI

SEQ ID NO: 1739 - protein, 9 aa, Homo sapiens
FLEEKIPSI

SEQ ID NO: 1740 - protein, 9 aa, Homo sapiens
FLEPVNPRL

SEQ ID NO: 1741 - protein, 9 aa, Homo sapiens
FLFDRPMHV

SEQ ID NO: 1742 - protein, 9 aa, Homo sapiens
FLFEPVVKA

SEQ ID NO: 1743 - protein, 9 aa, Homo sapiens
FLFNKVVNL

SEQ ID NO: 1744 - protein, 9 aa, Homo sapiens
FLFQEPRSI

SEQ ID NO: 1745 - protein, 9 aa, Homo sapiens
FLGEINDRL

SEQ ID NO: 1746 - protein, 9 aa, Homo sapiens
FLGEKIASV

SEQ ID NO: 1747 - protein, 9 aa, Homo sapiens
FLGSFIDHV

SEQ ID NO: 1748 - protein, 11 aa, Homo sapiens
FLHDDNMNFRV

SEQ ID NO: 1749 - protein, 9 aa, Homo sapiens
FLHDHQAEL

SEQ ID NO: 1750 - protein, 9 aa, Homo sapiens
FLHSLNIEM

SEQ ID NO: 1751 - protein, 10 aa, Homo sapiens
FLIEEQKIVV

SEQ ID NO: 1752 - protein, 10 aa, Homo sapiens
FLIEGTISRA

SEQ ID NO: 1753 - protein, 11 aa, Homo sapiens
FLIEPEHVNTV

SEQ ID NO: 1754 - protein, 10 aa, Homo sapiens
FLIGPKLYEA

SEQ ID NO: 1755 - protein, 9 aa, Homo sapiens
FLKEHMDEV

SEQ ID NO: 1756 - protein, 9 aa, Homo sapiens
FLLDKKIGV

SEQ ID NO: 1757 - protein, 11 aa, Homo sapiens
FLLDPVKGERL

SEQ ID NO: 1758 - protein, 9 aa, Homo sapiens
FLLEGIRSL

SEQ ID NO: 1759 - protein, 9 aa, Homo sapiens
FLLEKGYEV

SEQ ID NO: 1760 - protein, 9 aa, Homo sapiens
FLLEKPFSV

SEQ ID NO: 1761 - protein, 9 aa, Homo sapiens
FLLEKSRVV

SEQ ID NO: 1762 - protein, 9 aa, Homo sapiens
FLLENSSKV

SEQ ID NO: 1763 - protein, 9 aa, Homo sapiens
FLLETVVRV

SEQ ID NO: 1764 - protein, 9 aa, Homo sapiens
FLLGKEVSL

SEQ ID NO: 1765 - protein, 11 aa, Homo sapiens
FLLGPEGQHLL

SEQ ID NO: 1766 - protein, 10 aa, Homo sapiens
FLLGSVVHEV

SEQ ID NO: 1767 - protein, 9 aa, Homo sapiens
FLLHIQQQV

SEQ ID NO: 1768 - protein, 10 aa, Homo sapiens
FLLPHPGLKV

SEQ ID NO: 1769 - protein, 10 aa, Homo sapiens
FLLPIKTVGV

SEQ ID NO: 1770 - protein, 9 aa, Homo sapiens
FLLPKVQSI

SEQ ID NO: 1771 - protein, 9 aa, Homo sapiens
FLLQHQTFL

SEQ ID NO: 1772 - protein, 9 aa, Homo sapiens
FLLQHVQEL

SEQ ID NO: 1773 - protein, 9 aa, Homo sapiens
FLMDFIHQV

SEQ ID NO: 1774 - protein, 9 aa, Homo sapiens
FLMEEVHMI

SEQ ID NO: 1775 - protein, 11 aa, Homo sapiens
FLMKNSDLYGA

SEQ ID NO: 1776 - protein, 9 aa, Homo sapiens
FLMNEVIKL

SEQ ID NO: 1777 - protein, 9 aa, Homo sapiens
FLNGEVIRL

SEQ ID NO: 1778 - protein, 9 aa, Homo sapiens
FLNKEITSV

SEQ ID NO: 1779 - protein, 9 aa, Homo sapiens
FLNKMKIMV

SEQ ID NO: 1780 - protein, 11 aa, Homo sapiens
FLPETRIMTSV

SEQ ID NO: 1781 - protein, 9 aa, Homo sapiens
FLPRKFPSL

SEQ ID NO: 1782 - protein, 9 aa, Homo sapiens
FLQEHNTTL

SEQ ID NO: 1783 - protein, 9 aa, Homo sapiens
FLQEKLQEI

SEQ ID NO: 1784 - protein, 9 aa, Homo sapiens
FLQEKSPAV

SEQ ID NO: 1785 - protein, 10 aa, Homo sapiens
FLQENTHVRL

SEQ ID NO: 1786 - protein, 9 aa, Homo sapiens
FLQEYTVKL

SEQ ID NO: 1787 - protein, 9 aa, Homo sapiens
FLQLAVDKV

SEQ ID NO: 1788 - protein, 9 aa, Homo sapiens
FLQPELVKL

SEQ ID NO: 1789 - protein, 9 aa, Homo sapiens
FLQPHLDAV

SEQ ID NO: 1790 - protein, 9 aa, Homo sapiens
FLREYFERL

SEQ ID NO: 1791 - protein, 11 aa, Homo sapiens
FLSEEGGHVAV

SEQ ID NO: 1792 - protein, 10 aa, Homo sapiens
FLSEHPNVTL

SEQ ID NO: 1793 - protein, 11 aa, Homo sapiens
FLTDSNNIKEV

SEQ ID NO: 1794 - protein, 9 aa, Homo sapiens
FLTKQEILL

SEQ ID NO: 1795 - protein, 10 aa, Homo sapiens
FLVDGPRVQL

SEQ ID NO: 1796 - protein, 9 aa, Homo sapiens
FLVEHNLVL

SEQ ID NO: 1797 - protein, 9 aa, Homo sapiens
FLVEHVLTL

SEQ ID NO: 1798 - protein, 9 aa, Homo sapiens
FLWPKEVEL

SEQ ID NO: 1799 - protein, 9 aa, Homo sapiens
FLYAGHIFL

SEQ ID NO: 1800 - protein, 9 aa, Homo sapiens
FLYDDNQRV

SEQ ID NO: 1801 - protein, 9 aa, Homo sapiens
FLYDTHQNL

SEQ ID NO: 1802 - protein, 9 aa, Homo sapiens
FLYFEDHGL

SEQ ID NO: 1803 - protein, 10 aa, Homo sapiens
FLYQRLVVGA

SEQ ID NO: 1804 - protein, 10 aa, Homo sapiens
FMDPQKMPYL

SEQ ID NO: 1805 - protein, 10 aa, Homo sapiens
FMFDEKLVTV

SEQ ID NO: 1806 - protein, 9 aa, Homo sapiens
FMFGQKLNV

SEQ ID NO: 1807 - protein, 11 aa, Homo sapiens
FMIDASVHPTL

SEQ ID NO: 1808 - protein, 11 aa, Homo sapiens
FMLETVDSVKL

SEQ ID NO: 1809 - protein, 9 aa, Homo sapiens
FMMPRIVNV

SEQ ID NO: 1810 - protein, 9 aa, Homo sapiens
FMNDAIEKA

SEQ ID NO: 1811 - protein, 9 aa, Homo sapiens
FMVDRLESL

SEQ ID NO: 1812 - protein, 11 aa, Homo sapiens
FTFNIKDIHSV

SEQ ID NO: 1813 - protein, 9 aa, Homo sapiens
FVDERPEEV

SEQ ID NO: 1814 - protein, 9 aa, Homo sapiens
FVDGLTFKV

SEQ ID NO: 1815 - protein, 9 aa, Herpes simplex virus (type 1 / strain 17)
FVLATGDFV

SEQ ID NO: 1816 - protein, 10 aa, Homo sapiens
FVMEGEPPKL

SEQ ID NO: 1817 - protein, 9 aa, Herpes simplex virus (type 1 / strain 17)
GIFEDRAPV

SEQ ID NO: 1818 - protein, 10 aa, Homo sapiens
GIFGGHIRSV

SEQ ID NO: 1819 - protein, 9 aa, Homo sapiens
GILSHINTV

SEQ ID NO: 1820 - protein, 11 aa, Homo sapiens
GILTKELLHSV

SEQ ID NO: 1821 - protein, 9 aa, Homo sapiens
GLADKVYFL

SEQ ID NO: 1822 - protein, 11 aa, Homo sapiens
GLADNTVIAKV

SEQ ID NO: 1823 - protein, 9 aa, Homo sapiens
GLAPHLEQI

SEQ ID NO: 1824 - protein, 9 aa, Homo sapiens
GLAPLEVRV

SEQ ID NO: 1825 - protein, 10 aa, Homo sapiens
GLDDIKDLKV

SEQ ID NO: 1826 - protein, 9 aa, Homo sapiens
GLDHYVYKV

SEQ ID NO: 1827 - protein, 10 aa, Homo sapiens
GLDIDGIYRV

SEQ ID NO: 1828 - protein, 10 aa, Homo sapiens
GLDPNKPPEL

SEQ ID NO: 1829 - protein, 11 aa, Homo sapiens
GLDPQGDRSFL

SEQ ID NO: 1830 - protein, 10 aa, Homo sapiens
GLDPSGARLV

SEQ ID NO: 1831 - protein, 9 aa, Homo sapiens
GLDRLNVTV

SEQ ID NO: 1832 - protein, 9 aa, Homo sapiens
GLDRNAPSV

SEQ ID NO: 1833 - protein, 10 aa, Homo sapiens
GLDVDGIYRV

SEQ ID NO: 1834 - protein, 9 aa, Homo sapiens
GLFDQHFRL

SEQ ID NO: 1835 - protein, 9 aa, Homo sapiens
GLFQGKTPL

SEQ ID NO: 1836 - protein, 10 aa, Homo sapiens
GLFSNDIPHV

SEQ ID NO: 1837 - protein, 9 aa, Homo sapiens
GLGPPGRSV

SEQ ID NO: 1838 - protein, 8 aa, Homo sapiens
GLGPTFKL

SEQ ID NO: 1839 - protein, 9 aa, Homo sapiens
GLHFVVPSV

SEQ ID NO: 1840 - protein, 9 aa, Homo sapiens
GLIDRQVTV

SEQ ID NO: 1841 - protein, 10 aa, Homo sapiens
GLIDVKPLGV

SEQ ID NO: 1842 - protein, 9 aa, Homo sapiens
GLIEILKKV

SEQ ID NO: 1843 - protein, 11 aa, Homo sapiens
GLLAGDRLVEV

SEQ ID NO: 1844 - protein, 9 aa, Homo sapiens
GLLENIPRV

SEQ ID NO: 1845 - protein, 10 aa, Homo sapiens
GLLETTVQKV

SEQ ID NO: 1846 - protein, 10 aa, Homo sapiens
GLLREQVAQL

SEQ ID NO: 1847 - protein, 11 aa, Homo sapiens
GLMDEKLLHNV

SEQ ID NO: 1848 - protein, 9 aa, Homo sapiens
GLMDNEIKV

SEQ ID NO: 1849 - protein, 9 aa, Homo sapiens
GLMDTVKKV

SEQ ID NO: 1850 - protein, 10 aa, Homo sapiens
GLMGAGIAQV

SEQ ID NO: 1851 - protein, 9 aa, Homo sapiens
GLMKKAYEL

SEQ ID NO: 1852 - protein, 9 aa, Homo sapiens
GLMKYIGEV

SEQ ID NO: 1853 - protein, 9 aa, Homo sapiens
GLMQEKIYI

SEQ ID NO: 1854 - protein, 9 aa, Homo sapiens
GLNEEIARV

SEQ ID NO: 1855 - protein, 10 aa, Homo sapiens
GLPRFGIEMV

SEQ ID NO: 1856 - protein, 9 aa, Homo sapiens
GLQEGTHEL

SEQ ID NO: 1857 - protein, 11 aa, Homo sapiens
GLRRVDDFKKA

SEQ ID NO: 1858 - protein, 9 aa, Homo sapiens
GLSNHIAAL

SEQ ID NO: 1859 - protein, 10 aa, Homo sapiens
GLSTEGIYRV

SEQ ID NO: 1860 - protein, 10 aa, Homo sapiens
GLTGQRLLGV

SEQ ID NO: 1861 - protein, 9 aa, Homo sapiens
GLVDKLQAL

SEQ ID NO: 1862 - protein, 9 aa, Homo sapiens
GLVGALMHV

SEQ ID NO: 1863 - protein, 9 aa, Homo sapiens
GLVGSLQEV

SEQ ID NO: 1864 - protein, 11 aa, Homo sapiens
GLWEDGRSTLL

SEQ ID NO: 1865 - protein, 9 aa, Homo sapiens
GLWEEAYRV

SEQ ID NO: 1866 - protein, 11 aa, Homo sapiens
GLWGPEEEPHL

SEQ ID NO: 1867 - protein, 9 aa, Homo sapiens
GLWGPVHEL

SEQ ID NO: 1868 - protein, 10 aa, Homo sapiens
GLWSGPLPRV

SEQ ID NO: 1869 - protein, 10 aa, Homo sapiens
GLYDGPVHEV

SEQ ID NO: 1870 - protein, 11 aa, Homo sapiens
GLYDSQNPPTV

SEQ ID NO: 1871 - protein, 10 aa, Homo sapiens
GLYEFPLNKV

SEQ ID NO: 1872 - protein, 9 aa, Homo sapiens
GMAERIPEL

SEQ ID NO: 1873 - protein, 11 aa, Homo sapiens
GMYGKIAVMEL

SEQ ID NO: 1874 - protein, 9 aa, Homo sapiens
GMYIFLHTV

SEQ ID NO: 1875 - protein, 11 aa, Homo sapiens
GVAESIHLWEV

SEQ ID NO: 1876 - protein, 11 aa, Homo sapiens
GVAGGSILKGV

SEQ ID NO: 1877 - protein, 9 aa, Homo sapiens
HLAEALHQA

SEQ ID NO: 1878 - protein, 9 aa, Homo sapiens
HLAEVLERV

SEQ ID NO: 1879 - protein, 9 aa, Homo sapiens
HLAIKLEQV

SEQ ID NO: 1880 - protein, 9 aa, Homo sapiens
HLANIVERV

SEQ ID NO: 1881 - protein, 10 aa, Homo sapiens
HLAVKVANQA

SEQ ID NO: 1882 - protein, 9 aa, Homo sapiens
HLDATKLLL

SEQ ID NO: 1883 - protein, 10 aa, Homo sapiens
HLDPTEMEKV

SEQ ID NO: 1884 - protein, 10 aa, Homo sapiens
HLFDLTPAKV

SEQ ID NO: 1885 - protein, 10 aa, Homo sapiens
HLIDTNKIQL

SEQ ID NO: 1886 - protein, 9 aa, Homo sapiens
HLIHAPPEV

SEQ ID NO: 1887 - protein, 9 aa, Homo sapiens
HLLEHSVEL

SEQ ID NO: 1888 - protein, 9 aa, Homo sapiens
HLLERVDQV

SEQ ID NO: 1889 - protein, 9 aa, Homo sapiens
HLLSKLISV

SEQ ID NO: 1890 - protein, 12 aa, Homo sapiens
HLMEIQVNGGTV

SEQ ID NO: 1891 - protein, 9 aa, Homo sapiens
HLSELNTKL

SEQ ID NO: 1892 - protein, 9 aa, Homo sapiens
HLTDITLKV

SEQ ID NO: 1893 - protein, 9 aa, Homo sapiens
HLWRGIVSI

SEQ ID NO: 1894 - protein, 9 aa, Homo sapiens
HLYARQLTL

SEQ ID NO: 1895 - protein, 9 aa, Homo sapiens
HLYDIHVTV

SEQ ID NO: 1896 - protein, 9 aa, Homo sapiens
HLYSEVKEV

SEQ ID NO: 1897 - protein, 10 aa, Homo sapiens
IAAQDLLLAV

SEQ ID NO: 1898 - protein, 10 aa, Homo sapiens
IALNEKLVNL

SEQ ID NO: 1899 - protein, 10 aa, Homo sapiens
IIADMDKWTV

SEQ ID NO: 1900 - protein, 10 aa, Homo sapiens
IIAVSLAVNL

SEQ ID NO: 1901 - protein, 11 aa, Homo sapiens
IILEEGKEILV

SEQ ID NO: 1902 - protein, 9 aa, Homo sapiens
IINFSLLLV

SEQ ID NO: 1903 - protein, 9 aa, Homo sapiens
ILAAHVPTL

SEQ ID NO: 1904 - protein, 9 aa, Homo sapiens
ILAAVETRL

SEQ ID NO: 1905 - protein, 9 aa, Homo sapiens
ILAPVVKEI

SEQ ID NO: 1906 - protein, 9 aa, Homo sapiens
ILDAGGHNV

SEQ ID NO: 1907 - protein, 11 aa, Homo sapiens
ILDAGGHNVTI

SEQ ID NO: 1908 - protein, 9 aa, Homo sapiens
ILDDSPKEI

SEQ ID NO: 1909 - protein, 11 aa, Homo sapiens
ILDDTAKNLRV

SEQ ID NO: 1910 - protein, 9 aa, Homo sapiens
ILDEAIYKV

SEQ ID NO: 1911 - protein, 9 aa, Homo sapiens
ILDEHVQRV

SEQ ID NO: 1912 - protein, 11 aa, Homo sapiens
ILDEMSHKLRL

SEQ ID NO: 1913 - protein, 9 aa, Homo sapiens
ILDGNQLHI

SEQ ID NO: 1914 - protein, 9 aa, Homo sapiens
ILDISEHTL

SEQ ID NO: 1915 - protein, 9 aa, Homo sapiens
ILDKIVQKV

SEQ ID NO: 1916 - protein, 9 aa, Homo sapiens
ILDSGIYRI

SEQ ID NO: 1917 - protein, 10 aa, Homo sapiens
ILDSRGNPTV

SEQ ID NO: 1918 - protein, 9 aa, Homo sapiens
RLFENYIEL

SEQ ID NO: 1919 - protein, 9 aa, Human rotavirus
SLISGMWLL

SEQ ID NO: 1920 - protein, 10 aa, Homo sapiens
ILEEGKEILV

SEQ ID NO: 1921 - protein, 9 aa, Homo sapiens
ILEKKVEKV

SEQ ID NO: 1922 - protein, 9 aa, Homo sapiens
ILFGHENRV

SEQ ID NO: 1923 - protein, 9 aa, Homo sapiens
ILFNRVLGV

SEQ ID NO: 1924 - protein, 10 aa, Homo sapiens
ILGDRFSWNV

SEQ ID NO: 1925 - protein, 9 aa, Homo sapiens
ILHDDEVTV

SEQ ID NO: 1926 - protein, 9 aa, Homo sapiens
ILHDRLYYL

SEQ ID NO: 1927 - protein, 9 aa, Homo sapiens
ILHHKVYDL

SEQ ID NO: 1928 - protein, 11 aa, Homo sapiens
ILIEKEYLERV

SEQ ID NO: 1929 - protein, 11 aa, Homo sapiens
ILINDAGEVRL

SEQ ID NO: 1930 - protein, 9 aa, Homo sapiens
ILIRPLVSV

SEQ ID NO: 1931 - protein, 11 aa, Homo sapiens
ILLDDHGHIRI

SEQ ID NO: 1932 - protein, 11 aa, Homo sapiens
ILLDERGQIKL

SEQ ID NO: 1933 - protein, 10 aa, Homo sapiens
ILLDNDHYAM

SEQ ID NO: 1934 - protein, 9 aa, Homo sapiens
ILLDQTVRV

SEQ ID NO: 1935 - protein, 9 aa, Homo sapiens
ILLEHNYAL

SEQ ID NO: 1936 - protein, 11 aa, Homo sapiens
ILLNNSGQIKL

SEQ ID NO: 1937 - protein, 10 aa, Homo sapiens
ILLPDNVHYV

SEQ ID NO: 1938 - protein, 11 aa, Homo sapiens
ILLPEPSIRSV

SEQ ID NO: 1939 - protein, 9 aa, Homo sapiens
ILLPYVSKV

SEQ ID NO: 1940 - protein, 9 aa, Homo sapiens
ILLQGRLYL

SEQ ID NO: 1941 - protein, 9 aa, Homo sapiens
ILLRDLPTL

SEQ ID NO: 1942 - protein, 11 aa, Homo sapiens
ILLSEPGLVKL

SEQ ID NO: 1943 - protein, 11 aa, Homo sapiens
ILMEHIHKLKA

SEQ ID NO: 1944 - protein, 9 aa, Homo sapiens
ILMGVLKEV

SEQ ID NO: 1945 - protein, 9 aa, Homo sapiens
ILMHHPPQV

SEQ ID NO: 1946 - protein, 9 aa, Homo sapiens
ILMIFSHQI

SEQ ID NO: 1947 - protein, 9 aa, Homo sapiens
ILNKQEFFV

SEQ ID NO: 1948 - protein, 9 aa, Homo sapiens
ILNNKIPEA

SEQ ID NO: 1949 - protein, 9 aa, Homo sapiens
ILQDRLNQV

SEQ ID NO: 1950 - protein, 9 aa, Homo sapiens
ILQEKLQEI

SEQ ID NO: 1951 - protein, 9 aa, Homo sapiens
ILQEREYRL

SEQ ID NO: 1952 - protein, 9 aa, Homo sapiens
ILQNKIDLV

SEQ ID NO: 1953 - protein, 9 aa, Homo sapiens
ILQQHIATV

SEQ ID NO: 1954 - protein, 10 aa, Homo sapiens
ILQSTRLPLI

SEQ ID NO: 1955 - protein, 9 aa, Homo sapiens
ILSEVQQAV

SEQ ID NO: 1956 - protein, 9 aa, Homo sapiens
ILSGVIRSV

SEQ ID NO: 1957 - protein, 9 aa, Homo sapiens
ILTEAIKAA

SEQ ID NO: 1958 - protein, 9 aa, Homo sapiens
ILTESEIKL

SEQ ID NO: 1959 - protein, 9 aa, Homo sapiens
ILTNVVPKM

SEQ ID NO: 1960 - protein, 11 aa, Homo sapiens
ILWDLDHLTHV

SEQ ID NO: 1961 - protein, 9 aa, Homo sapiens
ILYDKLEKI

SEQ ID NO: 1962 - protein, 10 aa, Homo sapiens
ILYEHQLGQA

SEQ ID NO: 1963 - protein, 9 aa, Homo sapiens
ILYGEVEKL

SEQ ID NO: 1964 - protein, 9 aa, Homo sapiens
ILYGKIIHL

SEQ ID NO: 1965 - protein, 11 aa, Homo sapiens
IMAQLPQEQKA

SEQ ID NO: 1966 - protein, 9 aa, Homo sapiens
IMDDKSLNI

SEQ ID NO: 1967 - protein, 11 aa, Homo sapiens
IMLSEKHLISV

SEQ ID NO: 1968 - protein, 8 aa, Homo sapiens
IQDITQRL

SEQ ID NO: 1969 - protein, 9 aa, Homo sapiens
ITAKQLETL

SEQ ID NO: 1970 - protein, 9 aa, Homo sapiens
ITDDLHFYV

SEQ ID NO: 1971 - protein, 9 aa, Homo sapiens
IVDKTASFV

SEQ ID NO: 1972 - protein, 11 aa, Homo sapiens
IVLPAGALHQV

SEQ ID NO: 1973 - protein, 9 aa, Homo sapiens
IVMEHVVFL

SEQ ID NO: 1974 - protein, 9 aa, Homo sapiens
KIADFGWSV

SEQ ID NO: 1975 - protein, 10 aa, Homo sapiens
KIFDEILVNA

SEQ ID NO: 1976 - protein, 10 aa, Homo sapiens
KIFSGVFVKV

SEQ ID NO: 1977 - protein, 10 aa, Homo sapiens
KIFTEDLPEV

SEQ ID NO: 1978 - protein, 10 aa, Homo sapiens
KIGDFGLATV

SEQ ID NO: 1979 - protein, 9 aa, Homo sapiens
KIIDFIYTA

SEQ ID NO: 1980 - protein, 9 aa, Homo sapiens
KILDLETQL

SEQ ID NO: 1981 - protein, 9 aa, Homo sapiens
KILDYEVTL

SEQ ID NO: 1982 - protein, 9 aa, Homo sapiens
KILEDVVGV

SEQ ID NO: 1983 - protein, 9 aa, Homo sapiens
KILEELQKV

SEQ ID NO: 1984 - protein, 11 aa, Homo sapiens
KILNGKGILPT

SEQ ID NO: 1985 - protein, 9 aa, Homo sapiens
KILQELPSV

SEQ ID NO: 1986 - protein, 9 aa, Homo sapiens
KILSELFTV

SEQ ID NO: 1987 - protein, 9 aa, Homo sapiens
KIMDQVQQA

SEQ ID NO: 1988 - protein, 9 aa, Homo sapiens
KIMEKIRNV

SEQ ID NO: 1989 - protein, 9 aa, Homo sapiens
KIMESLPQI

SEQ ID NO: 1990 - protein, 11 aa, Homo sapiens
KIMTEKELLAV

SEQ ID NO: 1991 - protein, 9 aa, Homo sapiens
KLAAAISEV

SEQ ID NO: 1992 - protein, 11 aa, Homo sapiens
KLADDVDLEQV

SEQ ID NO: 1993 - protein, 11 aa, Homo sapiens
KLADFGDAVQL

SEQ ID NO: 1994 - protein, 10 aa, Toxoplasma gondii ME49
KLADFGLARA

SEQ ID NO: 1995 - protein, 10 aa, Homo sapiens
KLADISINYV

SEQ ID NO: 1996 - protein, 9 aa, Homo sapiens
KLADKLYNL

SEQ ID NO: 1997 - protein, 9 aa, Homo sapiens
KLAEGVLDV

SEQ ID NO: 1998 - protein, 9 aa, Homo sapiens
KLAEIVKQV

SEQ ID NO: 1999 - protein, 9 aa, Homo sapiens
KLAEKLTIL

SEQ ID NO: 2000 - protein, 10 aa, Homo sapiens
KLAENIDAQL

SEQ ID NO: 2001 - protein, 9 aa, Homo sapiens
KLAESVEKA

SEQ ID NO: 2002 - protein, 9 aa, Homo sapiens
KLAKLQAQV

SEQ ID NO: 2003 - protein, 10 aa, Homo sapiens
KLDDKDLPSV

SEQ ID NO: 2004 - protein, 11 aa, Homo sapiens
KLDDLTQDLTV

SEQ ID NO: 2005 - protein, 9 aa, Homo sapiens
KLDEHIAYL

SEQ ID NO: 2006 - protein, 11 aa, Homo sapiens
KLDETGNSLKV

SEQ ID NO: 2007 - protein, 11 aa, Homo sapiens
KLDPATSAVTV

SEQ ID NO: 2008 - protein, 9 aa, Homo sapiens
KLDQVIIHV

SEQ ID NO: 2009 - protein, 9 aa, Homo sapiens
KLFDRPQEL

SEQ ID NO: 2010 - protein, 11 aa, Homo sapiens
KLFDRPQELKL

SEQ ID NO: 2011 - protein, 9 aa, Homo sapiens
KLFEDELTL

SEQ ID NO: 2012 - protein, 9 aa, Homo sapiens
KLFEKVKEV

SEQ ID NO: 2013 - protein, 9 aa, Homo sapiens
KLFGHLTSA

SEQ ID NO: 2014 - protein, 9 aa, Homo sapiens
KLFSELPLA

SEQ ID NO: 2015 - protein, 9 aa, Homo sapiens
KLGELTMQL

SEQ ID NO: 2016 - protein, 11 aa, Homo sapiens
KLGHTDILVGV

SEQ ID NO: 2017 - protein, 9 aa, Homo sapiens
KLGLKPLEV

SEQ ID NO: 2018 - protein, 9 aa, Homo sapiens
KLHDINAQL

SEQ ID NO: 2019 - protein, 10 aa, Homo sapiens
KLHDVELHQV

SEQ ID NO: 2020 - protein, 9 aa, Homo sapiens
KLHGVNINV

SEQ ID NO: 2021 - protein, 10 aa, Homo sapiens
KLIDGQVIQL

SEQ ID NO: 2022 - protein, 9 aa, Homo sapiens
KLIEELETL

SEQ ID NO: 2023 - protein, 10 aa, Homo sapiens
KLIEKLDIKL

SEQ ID NO: 2024 - protein, 9 aa, Homo sapiens
KLILLITQV

SEQ ID NO: 2025 - protein, 9 aa, Homo sapiens
KLIPFLEKL

SEQ ID NO: 2026 - protein, 9 aa, Homo sapiens
KLIPQLPTL

SEQ ID NO: 2027 - protein, 9 aa, Homo sapiens
KLIQNVFEI

SEQ ID NO: 2028 - protein, 9 aa, Homo sapiens
KLLAVIHEL

SEQ ID NO: 2029 - protein, 9 aa, Homo sapiens
KLLDIRSYL

SEQ ID NO: 2030 - protein, 11 aa, Homo sapiens
KLLDISELDMV

SEQ ID NO: 2031 - protein, 9 aa, Homo sapiens
KLLDLMPRL

SEQ ID NO: 2032 - protein, 9 aa, Homo sapiens
KLLDLQVRV

SEQ ID NO: 2033 - protein, 11 aa, Homo sapiens
KLLDLSDSTSV

SEQ ID NO: 2034 - protein, 9 aa, Homo sapiens
KLLDQMPSL

SEQ ID NO: 2035 - protein, 9 aa, Homo sapiens
KLLDVVHPA

SEQ ID NO: 2036 - protein, 9 aa, Homo sapiens
KLLEATSAV

SEQ ID NO: 2037 - protein, 10 aa, Homo sapiens
KLLEEQGIFL

SEQ ID NO: 2038 - protein, 10 aa, Homo sapiens
KLLEIDIDGV

SEQ ID NO: 2039 - protein, 9 aa, Homo sapiens
KLLEKAFSI

SEQ ID NO: 2040 - protein, 12 aa, Homo sapiens
KLLELDPEHQRA

SEQ ID NO: 2041 - protein, 11 aa, Homo sapiens
KLLELEKHIRV

SEQ ID NO: 2042 - protein, 10 aa, Homo sapiens
KLLEPVPVSV

SEQ ID NO: 2043 - protein, 9 aa, Homo sapiens
KLLERLPEA

SEQ ID NO: 2044 - protein, 9 aa, Homo sapiens
KLLERVSAI

SEQ ID NO: 2045 - protein, 9 aa, Homo sapiens
KLLEVQPQV

SEQ ID NO: 2046 - protein, 9 aa, Homo sapiens
KLLEVYEQL

SEQ ID NO: 2047 - protein, 9 aa, Homo sapiens
KLLEYIEEI

SEQ ID NO: 2048 - protein, 9 aa, Homo sapiens
KLLGYDVHV

SEQ ID NO: 2049 - protein, 9 aa, Homo sapiens
KLLKDLPEL

SEQ ID NO: 2050 - protein, 9 aa, Homo sapiens
KLLTEVHAA

SEQ ID NO: 2051 - protein, 9 aa, Homo sapiens
KLMDEVAGI

SEQ ID NO: 2052 - protein, 9 aa, Homo sapiens
KLMDHIYAV

SEQ ID NO: 2053 - protein, 9 aa, Homo sapiens
KLMDKVVRL

SEQ ID NO: 2054 - protein, 10 aa, Homo sapiens
KLMDLDVEQL

SEQ ID NO: 2055 - protein, 9 aa, Homo sapiens
KLMDQLEAL

SEQ ID NO: 2056 - protein, 9 aa, Homo sapiens
KLNPQQFEV

SEQ ID NO: 2057 - protein, 9 aa, Homo sapiens
KLPEKWESV

SEQ ID NO: 2058 - protein, 9 aa, Homo sapiens
KLPPPPPQA

SEQ ID NO: 2059 - protein, 9 aa, Homo sapiens
KLQDQIFNL

SEQ ID NO: 2060 - protein, 9 aa, Homo sapiens
KLQELENRL

SEQ ID NO: 2061 - protein, 9 aa, Homo sapiens
KLQELNYNL

SEQ ID NO: 2062 - protein, 9 aa, Homo sapiens
KLQEQIFHL

SEQ ID NO: 2063 - protein, 9 aa, Homo sapiens
KLSDLQTQL

SEQ ID NO: 2064 - protein, 9 aa, Homo sapiens
KLSEVLQAV

SEQ ID NO: 2065 - protein, 9 aa, Homo sapiens
KLVELPYTV

SEQ ID NO: 2066 - protein, 9 aa, Homo sapiens
KLVKEVIAV

SEQ ID NO: 2067 - protein, 9 aa, Homo sapiens
KLVMEIIKL

SEQ ID NO: 2068 - protein, 9 aa, Homo sapiens
KLWEAESKL

SEQ ID NO: 2069 - protein, 9 aa, Homo sapiens
KLWGQSIQL

SEQ ID NO: 2070 - protein, 9 aa, Homo sapiens
KLYDGFQYL

SEQ ID NO: 2071 - protein, 9 aa, Homo sapiens
KLYEEINQV

SEQ ID NO: 2072 - protein, 9 aa, Homo sapiens
KLYEQHHVV

SEQ ID NO: 2073 - protein, 11 aa, Homo sapiens
KLYGPEGLELV

SEQ ID NO: 2074 - protein, 10 aa, Homo sapiens
KLYPQLPAEI

SEQ ID NO: 2075 - protein, 9 aa, Homo sapiens
KLYQHEINL

SEQ ID NO: 2076 - protein, 9 aa, Homo sapiens
KLYQRDLEV

SEQ ID NO: 2077 - protein, 9 aa, Homo sapiens
KLYTGLREV

SEQ ID NO: 2078 - protein, 9 aa, Homo sapiens
KMAEMLVEL

SEQ ID NO: 2079 - protein, 11 aa, Homo sapiens
KMFDLNGDGEV

SEQ ID NO: 2080 - protein, 9 aa, Homo sapiens
KMLEKLPEL

SEQ ID NO: 2081 - protein, 9 aa, Homo sapiens
KMMDVTVTI

SEQ ID NO: 2082 - protein, 9 aa, Homo sapiens
KMSEKILLL

SEQ ID NO: 2083 - protein, 9 aa, Homo sapiens
KMWEEAISL

SEQ ID NO: 2084 - protein, 10 aa, Homo sapiens
KMYEEFLSKV

SEQ ID NO: 2085 - protein, 10 aa, Homo sapiens
KTVDGPSGKL

SEQ ID NO: 2086 - protein, 9 aa, Homo sapiens
KVANIIAEV

SEQ ID NO: 2087 - protein, 9 aa, Homo sapiens
KVLDFEHFL

SEQ ID NO: 2088 - protein, 9 aa, Homo sapiens
KVLEILHRV

SEQ ID NO: 2089 - protein, 11 aa, Homo sapiens
KVLEPSETLVV

SEQ ID NO: 2090 - protein, 9 aa, Homo sapiens
KVLERVNAV

SEQ ID NO: 2091 - protein, 9 aa, Homo sapiens
KVLGIVVGV

SEQ ID NO: 2092 - protein, 9 aa, Homo sapiens
KVMDEVEKA

SEQ ID NO: 2093 - protein, 9 aa, Homo sapiens
KVMELLVHL

SEQ ID NO: 2094 - protein, 12 aa, Homo sapiens
KVVLTQANKLGV

SEQ ID NO: 2095 - protein, 9 aa, Homo sapiens
LADETLLKV

SEQ ID NO: 2096 - protein, 11 aa, Homo sapiens
LIEECGGLEKI

SEQ ID NO: 2097 - protein, 8 aa, Homo sapiens
LIGQVHEV

SEQ ID NO: 2098 - protein, 11 aa, Homo sapiens
LIRGPAETEAT

SEQ ID NO: 2099 - protein, 9 aa, Homo sapiens
LLAAWTARA

SEQ ID NO: 2100 - protein, 9 aa, Homo sapiens
LLADLLHNV

SEQ ID NO: 2101 - protein, 9 aa, Homo sapiens
LLADRSWLL

SEQ ID NO: 2102 - protein, 9 aa, Homo sapiens
LLAEAKYYL

SEQ ID NO: 2103 - protein, 9 aa, Homo sapiens
LLAEKIYKI

SEQ ID NO: 2104 - protein, 9 aa, Homo sapiens
LLAETHYQL

SEQ ID NO: 2105 - protein, 11 aa, Homo sapiens
LLAILPEAARA

SEQ ID NO: 2106 - protein, 9 aa, Homo sapiens
LLAKEVQLV

SEQ ID NO: 2107 - protein, 9 aa, Homo sapiens
LLAPRPVAV

SEQ ID NO: 2108 - protein, 9 aa, Homo sapiens
LLDATQHTL

SEQ ID NO: 2109 - protein, 9 aa, Homo sapiens
LLDEEISRV

SEQ ID NO: 2110 - protein, 9 aa, Homo sapiens
LLDIIKSTV

SEQ ID NO: 2111 - protein, 8 aa, Homo sapiens
LLDKKIGV

SEQ ID NO: 2112 - protein, 11 aa, Homo sapiens
LLDPNVKSIFV

SEQ ID NO: 2113 - protein, 9 aa, Homo sapiens
LLDQTKTLA

SEQ ID NO: 2114 - protein, 9 aa, Homo sapiens
LLDRFLATV

SEQ ID NO: 2115 - protein, 9 aa, Homo sapiens
LLDSQSHHL

SEQ ID NO: 2116 - protein, 9 aa, Homo sapiens
LLDVTPKAV

SEQ ID NO: 2117 - protein, 9 aa, Homo sapiens
LLFDKFNAV

SEQ ID NO: 2118 - protein, 9 aa, Homo sapiens
LLFDRPMHV

SEQ ID NO: 2119 - protein, 10 aa, Homo sapiens
LLFEGEKITI

SEQ ID NO: 2120 - protein, 9 aa, Homo sapiens
LLFEGIARI

SEQ ID NO: 2121 - protein, 10 aa, Homo sapiens
LLFSGNIQEA

SEQ ID NO: 2122 - protein, 9 aa, Homo sapiens
LLGPPPVGV

SEQ ID NO: 2123 - protein, 8 aa, Homo sapiens
LLGRVYDV

SEQ ID NO: 2124 - protein, 11 aa, Homo sapiens
LLIASGANLLA

SEQ ID NO: 2125 - protein, 11 aa, Homo sapiens
LLIDDKGTIKL

SEQ ID NO: 2126 - protein, 9 aa, Human gammaherpesvirus 4
LLIEGIFFI

SEQ ID NO: 2127 - protein, 9 aa, Homo sapiens
LLIGHLERV

SEQ ID NO: 2128 - protein, 9 aa, Homo sapiens
LLIKQVVEV

SEQ ID NO: 2129 - protein, 10 aa, Homo sapiens
LLKVDVQGEI

SEQ ID NO: 2130 - protein, 9 aa, Homo sapiens
LLLDRIASV

SEQ ID NO: 2131 - protein, 9 aa, Homo sapiens
LLLGERVAL

SEQ ID NO: 2132 - protein, 9 aa, Homo sapiens
LLLGHVAQV

SEQ ID NO: 2133 - protein, 11 aa, Homo sapiens
LLLPEHVLVKI

SEQ ID NO: 2134 - protein, 12 aa, Homo sapiens
LLLPGELAKHAV

SEQ ID NO: 2135 - protein, 9 aa, Homo sapiens
LLLQHSPAL

SEQ ID NO: 2136 - protein, 9 aa, Homo sapiens
LLMDRVDEM

SEQ ID NO: 2137 - protein, 9 aa, Homo sapiens
LLMEHIFKL

SEQ ID NO: 2138 - protein, 9 aa, Homo sapiens
LLMEHIQEI

SEQ ID NO: 2139 - protein, 9 aa, Homo sapiens
LLNDRIWLA

SEQ ID NO: 2140 - protein, 9 aa, Homo sapiens
LLNSEVHML

SEQ ID NO: 2141 - protein, 9 aa, Homo sapiens
LLQDAIREV

SEQ ID NO: 2142 - protein, 9 aa, Homo sapiens
LLQDKQFEL

SEQ ID NO: 2143 - protein, 9 aa, Homo sapiens
LLQEVEHQL

SEQ ID NO: 2144 - protein, 9 aa, Homo sapiens
LLQPHLERV

SEQ ID NO: 2145 - protein, 9 aa, Homo sapiens
LLQRKVEEV

SEQ ID NO: 2146 - protein, 9 aa, Herpes simplex virus (type 1 / strain 17)
LLTTPKFTV

SEQ ID NO: 2147 - protein, 9 aa, Homo sapiens
LLVDVEPKV

SEQ ID NO: 2148 - protein, 12 aa, Homo sapiens
LLVGCTECALLA

SEQ ID NO: 2149 - protein, 10 aa, Homo sapiens
LLYDGKLSSA

SEQ ID NO: 2150 - protein, 11 aa, Homo sapiens
LLYDLADQLHA

SEQ ID NO: 2151 - protein, 9 aa, Homo sapiens
LLYEKGISL

SEQ ID NO: 2152 - protein, 10 aa, Homo sapiens
LLYQGPHNTL

SEQ ID NO: 2153 - protein, 10 aa, Homo sapiens
LMAEMGVHSV

SEQ ID NO: 2154 - protein, 9 aa, Homo sapiens
LMAHAMEEV

SEQ ID NO: 2155 - protein, 9 aa, Homo sapiens
LMIENLPKL

SEQ ID NO: 2156 - protein, 11 aa, Homo sapiens
LMLAGGQITGL

SEQ ID NO: 2157 - protein, 9 aa, Homo sapiens
LMQTEVHHV

SEQ ID NO: 2158 - protein, 9 aa, Homo sapiens
LMVDHVTEV

SEQ ID NO: 2159 - protein, 10 aa, Homo sapiens
LTAAQLLDTL

SEQ ID NO: 2160 - protein, 9 aa, Homo sapiens
LVIDVIHEV

SEQ ID NO: 2161 - protein, 9 aa, Homo sapiens
LVKGHAYSI

SEQ ID NO: 2162 - protein, 10 aa, Homo sapiens
LVQPRVEFIL

SEQ ID NO: 2163 - protein, 8 aa, Homo sapiens
LVRPGTAL

SEQ ID NO: 2164 - protein, 10 aa, Homo sapiens
LVRPGTALEL

SEQ ID NO: 2165 - protein, 10 aa, Homo sapiens
LVVRHQLLKT

SEQ ID NO: 2166 - protein, 9 aa, Homo sapiens
MAELKGYNL

SEQ ID NO: 2167 - protein, 9 aa, Homo sapiens
MLANDIARL

SEQ ID NO: 2168 - protein, 9 aa, Homo sapiens
MLATRVFSL

SEQ ID NO: 2169 - protein, 9 aa, Homo sapiens
MLFGHPLLV

SEQ ID NO: 2170 - protein, 9 aa, Homo sapiens
MLKEAHIEL

SEQ ID NO: 2171 - protein, 9 aa, Homo sapiens
MLLDTVQKV

SEQ ID NO: 2172 - protein, 9 aa, Homo sapiens
MLLEGLREL

SEQ ID NO: 2173 - protein, 9 aa, Homo sapiens
MLLEKLPQV

SEQ ID NO: 2174 - protein, 9 aa, Homo sapiens
MLNEHDFEV

SEQ ID NO: 2175 - protein, 9 aa, Homo sapiens
MLQDSIHVV

SEQ ID NO: 2176 - protein, 9 aa, Homo sapiens
MLQEKLKEL

SEQ ID NO: 2177 - protein, 10 aa, Homo sapiens
NILEKGGDPL

SEQ ID NO: 2178 - protein, 9 aa, Homo sapiens
NIVEKLREV

SEQ ID NO: 2179 - protein, 9 aa, Homo sapiens
NIVERVKEV

SEQ ID NO: 2180 - protein, 9 aa, Homo sapiens
NLAEKLIGV

SEQ ID NO: 2181 - protein, 9 aa, Homo sapiens
NLAEVVERV

SEQ ID NO: 2182 - protein, 9 aa, Homo sapiens
NLASRIPAA

SEQ ID NO: 2183 - protein, 9 aa, Homo sapiens
NLFNRYPAL

SEQ ID NO: 2184 - protein, 9 aa, Homo sapiens
NLLEIAPHL

SEQ ID NO: 2185 - protein, 9 aa, Homo sapiens
NLLSFTYKL

SEQ ID NO: 2186 - protein, 9 aa, Herpes simplex virus (type 1 / strain 17)
NLLTTPKFT

SEQ ID NO: 2187 - protein, 9 aa, Homo sapiens
NLMDDIERA

SEQ ID NO: 2188 - protein, 9 aa, Homo sapiens
NLVEKTPAL

SEQ ID NO: 2189 - protein, 12 aa, Homo sapiens
NMLGGKYQGTIL

SEQ ID NO: 2190 - protein, 9 aa, Homo sapiens
NMVDIIHSV

SEQ ID NO: 2191 - protein, 9 aa, Homo sapiens
NMYGKVVTV

SEQ ID NO: 2192 - protein, 10 aa, Homo sapiens
NQWDGTQHGV

SEQ ID NO: 2193 - protein, 9 aa, Homo sapiens
PLKQGGAKA

SEQ ID NO: 2194 - protein, 9 aa, Homo sapiens
QILENELQI

SEQ ID NO: 2195 - protein, 11 aa, Homo sapiens
QLAEDIEALKV

SEQ ID NO: 2196 - protein, 9 aa, Homo sapiens
QLDDLKVEL

SEQ ID NO: 2197 - protein, 9 aa, Homo sapiens
QLDSHVHAV

SEQ ID NO: 2198 - protein, 9 aa, Homo sapiens
QLIDIIHTA

SEQ ID NO: 2199 - protein, 9 aa, Homo sapiens
QLIDKVWQL

SEQ ID NO: 2200 - protein, 9 aa, Homo sapiens
QLLEKVIEL

SEQ ID NO: 2201 - protein, 9 aa, Homo sapiens
QLLQHVQAV

SEQ ID NO: 2202 - protein, 11 aa, Homo sapiens
QLQEGKNVIGL

SEQ ID NO: 2203 - protein, 9 aa, Homo sapiens
QLQGYLRSV

SEQ ID NO: 2204 - protein, 9 aa, Homo sapiens
QLTNVILHL

SEQ ID NO: 2205 - protein, 9 aa, Homo sapiens
QLVESLHKV

SEQ ID NO: 2206 - protein, 9 aa, Homo sapiens
QLVQRVASV

SEQ ID NO: 2207 - protein, 9 aa, Homo sapiens
QMISRIEYI

SEQ ID NO: 2208 - protein, 9 aa, Homo sapiens
QMLDVAIRV

SEQ ID NO: 2209 - protein, 11 aa, Homo sapiens
QMLEAIKALEV

SEQ ID NO: 2210 - protein, 9 aa, Bos taurus
RALPDFKGI

SEQ ID NO: 2211 - protein, 9 aa, Homo sapiens
RIIDVVYNA

SEQ ID NO: 2212 - protein, 11 aa, Homo sapiens
RLAEVGQYEQV

SEQ ID NO: 2213 - protein, 9 aa, Homo sapiens
RLAEVVHEL

SEQ ID NO: 2214 - protein, 11 aa, Homo sapiens
RLAGADVVLGV

SEQ ID NO: 2215 - protein, 9 aa, Homo sapiens
RLAQHITYV

SEQ ID NO: 2216 - protein, 9 aa, Homo sapiens
RLDDNIRTV

SEQ ID NO: 2217 - protein, 9 aa, Homo sapiens
RLFGILAHV

SEQ ID NO: 2218 - protein, 9 aa, Homo sapiens
RLFHYRITV

SEQ ID NO: 2219 - protein, 11 aa, Homo sapiens
RLFNHPNILRL

SEQ ID NO: 2220 - protein, 11 aa, Homo sapiens
RLGEAEGLMKV

SEQ ID NO: 2221 - protein, 9 aa, Homo sapiens
RLIDLHTNV

SEQ ID NO: 2222 - protein, 10 aa, Homo sapiens
RLLDEEISRV

SEQ ID NO: 2223 - protein, 9 aa, Homo sapiens
RLLDGAFKL

SEQ ID NO: 2224 - protein, 9 aa, Homo sapiens
RLLDSEIKI

SEQ ID NO: 2225 - protein, 9 aa, Homo sapiens
RLLDSVRAI

SEQ ID NO: 2226 - protein, 9 aa, Homo sapiens
RLLDYVVNI

SEQ ID NO: 2227 - protein, 11 aa, Homo sapiens
RLLEEGVLRQI

SEQ ID NO: 2228 - protein, 10 aa, Homo sapiens
RLLEGYEIYV

SEQ ID NO: 2229 - protein, 9 aa, Homo sapiens
RLLEIDPYL

SEQ ID NO: 2230 - protein, 9 aa, Homo sapiens
RLLEQKVEL

SEQ ID NO: 2231 - protein, 9 aa, Homo sapiens
RLLEQLQEI

SEQ ID NO: 2232 - protein, 9 aa, Homo sapiens
RLLEVVTSI

SEQ ID NO: 2233 - protein, 9 aa, Homo sapiens
RLLQEQHQL

SEQ ID NO: 2234 - protein, 9 aa, Homo sapiens
RLMGSILGV

SEQ ID NO: 2235 - protein, 10 aa, Homo sapiens
RLMNLPLHSV

SEQ ID NO: 2236 - protein, 9 aa, Homo sapiens
RLNEKNYEL

SEQ ID NO: 2237 - protein, 9 aa, Homo sapiens
RLQDAIAKV

SEQ ID NO: 2238 - protein, 10 aa, Homo sapiens
RLQEDPPAGV

SEQ ID NO: 2239 - protein, 10 aa, Homo sapiens
RLQEDPPVGV

SEQ ID NO: 2240 - protein, 9 aa, Homo sapiens
RLQEEINEV

SEQ ID NO: 2241 - protein, 9 aa, Homo sapiens
RLQESVMEA

SEQ ID NO: 2242 - protein, 9 aa, Homo sapiens
RLSDVQIYV

SEQ ID NO: 2243 - protein, 10 aa, Homo sapiens
RLSELGITQA

SEQ ID NO: 2244 - protein, 9 aa, Homo sapiens
RLTDYISKV

SEQ ID NO: 2245 - protein, 9 aa, Homo sapiens
RLTPKLMEV

SEQ ID NO: 2246 - protein, 9 aa, Homo sapiens
RLVEIQYEL

SEQ ID NO: 2247 - protein, 11 aa, Homo sapiens
RLVQGSILKKV

SEQ ID NO: 2248 - protein, 9 aa, Homo sapiens
RLWNETVEL

SEQ ID NO: 2249 - protein, 9 aa, Homo sapiens
RLYDGLFKV

SEQ ID NO: 2250 - protein, 12 aa, Homo sapiens
RLYDPASGTISL

SEQ ID NO: 2251 - protein, 9 aa, Homo sapiens
RMFDGKFVV

SEQ ID NO: 2252 - protein, 10 aa, Homo sapiens
RMFDGKFVVA

SEQ ID NO: 2253 - protein, 9 aa, Homo sapiens
RMLDSVEKL

SEQ ID NO: 2254 - protein, 12 aa, Homo sapiens
RVITEEEKNFKA

SEQ ID NO: 2255 - protein, 11 aa, Homo sapiens
RVLEVGALQAV

SEQ ID NO: 2256 - protein, 11 aa, Homo sapiens
RVLPPSALQSV

SEQ ID NO: 2257 - protein, 9 aa, Homo sapiens
RVPPPPQSV

SEQ ID NO: 2258 - protein, 11 aa, Homo sapiens
RVVGPISGADL

SEQ ID NO: 2259 - protein, 9 aa, Homo sapiens
SIIQRLLEV

SEQ ID NO: 2260 - protein, 9 aa, Homo sapiens
SILRHVAEV

SEQ ID NO: 2261 - protein, 9 aa, Homo sapiens
SLADLYFRA

SEQ ID NO: 2262 - protein, 9 aa, Homo sapiens
SLADVHIEV

SEQ ID NO: 2263 - protein, 9 aa, Homo sapiens
SLAEGLRTV

SEQ ID NO: 2264 - protein, 9 aa, Homo sapiens
SLAEGRLYL

SEQ ID NO: 2265 - protein, 9 aa, Homo sapiens
SLAEKIQAL

SEQ ID NO: 2266 - protein, 10 aa, Homo sapiens
SLAELKGFEV

SEQ ID NO: 2267 - protein, 9 aa, Homo sapiens
SLAELVHAV

SEQ ID NO: 2268 - protein, 10 aa, Homo sapiens
SLAETDKITL

SEQ ID NO: 2269 - protein, 9 aa, Homo sapiens
SLAHELWKV

SEQ ID NO: 2270 - protein, 9 aa, Homo sapiens
SLANETHQL

SEQ ID NO: 2271 - protein, 9 aa, Homo sapiens
SLAPIIVHV

SEQ ID NO: 2272 - protein, 9 aa, Homo sapiens
SLAQYNPKL

SEQ ID NO: 2273 - protein, 9 aa, Homo sapiens
SLASIHVPL

SEQ ID NO: 2274 - protein, 9 aa, Homo sapiens
SLASLLAKV

SEQ ID NO: 2275 - protein, 9 aa, Homo sapiens
SLATSLPRL

SEQ ID NO: 2276 - protein, 11 aa, Homo sapiens
SLDESGEHMGV

SEQ ID NO: 2277 - protein, 9 aa, Homo sapiens
SLDNRINEV

SEQ ID NO: 2278 - protein, 9 aa, Homo sapiens
SLDSTLHAV

SEQ ID NO: 2279 - protein, 10 aa, Homo sapiens
SLFAGGMLRV

SEQ ID NO: 2280 - protein, 10 aa, Homo sapiens
SLFDLDGPKV

SEQ ID NO: 2281 - protein, 10 aa, Homo sapiens
SLFEKGLKNV

SEQ ID NO: 2282 - protein, 9 aa, Homo sapiens
SLFERLVKV

SEQ ID NO: 2283 - protein, 9 aa, Homo sapiens
SLFGGSVKL

SEQ ID NO: 2284 - protein, 10 aa, Homo sapiens
SLFPHNPQFI

SEQ ID NO: 2285 - protein, 9 aa, Homo sapiens
SLFQSRISL

SEQ ID NO: 2286 - protein, 9 aa, Homo sapiens
SLFRVITEV

SEQ ID NO: 2287 - protein, 8 aa, Homo sapiens
SLGKVFGV

SEQ ID NO: 2288 - protein, 9 aa, Homo sapiens
SLGRFEITV

SEQ ID NO: 2289 - protein, 10 aa, Homo sapiens
SLGSALRPST

SEQ ID NO: 2290 - protein, 9 aa, Homo sapiens
SLIAGVIRV

SEQ ID NO: 2291 - protein, 9 aa, Homo sapiens
SLIDKTTAA

SEQ ID NO: 2292 - protein, 9 aa, Homo sapiens
SLIEKIPTA

SEQ ID NO: 2293 - protein, 9 aa, Homo sapiens
SLIEKLWQT

SEQ ID NO: 2294 - protein, 9 aa, Homo sapiens
SLIEKYFSV

SEQ ID NO: 2295 - protein, 9 aa, Homo sapiens
SLIGNLHLA

SEQ ID NO: 2296 - protein, 9 aa, Homo sapiens
SLIQRLMSV

SEQ ID NO: 2297 - protein, 9 aa, Homo sapiens
SLKNRIESV

SEQ ID NO: 2298 - protein, 9 aa, Homo sapiens
SLLDKIIGA

SEQ ID NO: 2299 - protein, 11 aa, Homo sapiens
SLLEDKGLAEV

SEQ ID NO: 2300 - protein, 9 aa, Homo sapiens
SLLEHLSHV

SEQ ID NO: 2301 - protein, 10 aa, Homo sapiens
SLLEKELESV

SEQ ID NO: 2302 - protein, 10 aa, Homo sapiens
SLLEKQQIYL

SEQ ID NO: 2303 - protein, 9 aa, Homo sapiens
SLLENIAKA

SEQ ID NO: 2304 - protein, 9 aa, Homo sapiens
SLLENLEKI

SEQ ID NO: 2305 - protein, 9 aa, Homo sapiens
SLLESVQKL

SEQ ID NO: 2306 - protein, 12 aa, Homo sapiens
SLLGGDVVSVKL

SEQ ID NO: 2307 - protein, 11 aa, Homo sapiens
SLLKEPQKVQL

SEQ ID NO: 2308 - protein, 9 aa, Homo sapiens
SLLKRDFGA

SEQ ID NO: 2309 - protein, 10 aa, Homo sapiens
SLLPTEQPRL

SEQ ID NO: 2310 - protein, 9 aa, Homo sapiens
SLLQKQIML

SEQ ID NO: 2311 - protein, 9 aa, Homo sapiens
SLLQTLYKV

SEQ ID NO: 2312 - protein, 9 aa, Homo sapiens
SLLQTQHAL

SEQ ID NO: 2313 - protein, 9 aa, Homo sapiens
SLLRVGWSV

SEQ ID NO: 2314 - protein, 9 aa, Homo sapiens
SLLTSTVQV

SEQ ID NO: 2315 - protein, 9 aa, Homo sapiens
SLMEKISKL

SEQ ID NO: 2316 - protein, 11 aa, Homo sapiens
SLMEKVRNMAL

SEQ ID NO: 2317 - protein, 10 aa, Homo sapiens
SLMGPVVHEV

SEQ ID NO: 2318 - protein, 9 aa, Homo sapiens
SLNGLEVHL

SEQ ID NO: 2319 - protein, 9 aa, Homo sapiens
SLNKHVEAV

SEQ ID NO: 2320 - protein, 9 aa, Homo sapiens
SLPDHLPSV

SEQ ID NO: 2321 - protein, 9 aa, Homo sapiens
SLPDIKVYL

SEQ ID NO: 2322 - protein, 9 aa, Homo sapiens
SLPKKLALL

SEQ ID NO: 2323 - protein, 9 aa, Homo sapiens
SLQDEIQRV

SEQ ID NO: 2324 - protein, 9 aa, Homo sapiens
SLQEKLWAI

SEQ ID NO: 2325 - protein, 9 aa, Homo sapiens
SLREACETV

SEQ ID NO: 2326 - protein, 9 aa, Homo sapiens
SLSDKTPSV

SEQ ID NO: 2327 - protein, 9 aa, Homo sapiens
SLSDTVEKL

SEQ ID NO: 2328 - protein, 9 aa, Homo sapiens
SLSFMNPRL

SEQ ID NO: 2329 - protein, 9 aa, Homo sapiens
SLSSFLHGV

SEQ ID NO: 2330 - protein, 11 aa, Homo sapiens
SLVENIERLKV

SEQ ID NO: 2331 - protein, 9 aa, Homo sapiens
SLVNQVPKI

SEQ ID NO: 2332 - protein, 9 aa, Homo sapiens
SLWANPKYV

SEQ ID NO: 2333 - protein, 9 aa, Homo sapiens
SLYDWNVKL

SEQ ID NO: 2334 - protein, 9 aa, Homo sapiens
SLYEMVSRV

SEQ ID NO: 2335 - protein, 9 aa, Homo sapiens
SLYGYLRGA

SEQ ID NO: 2336 - protein, 9 aa, Homo sapiens
SLYSQVHQI

SEQ ID NO: 2337 - protein, 9 aa, Homo sapiens
SMLDDLRNV

SEQ ID NO: 2338 - protein, 9 aa, Homo sapiens
SMLEDVQRA

SEQ ID NO: 2339 - protein, 9 aa, Homo sapiens
SMLNRILAV

SEQ ID NO: 2340 - protein, 9 aa, Homo sapiens
SMLQKTWLL

SEQ ID NO: 2341 - protein, 9 aa, Homo sapiens
SMMDRMFAL

SEQ ID NO: 2342 - protein, 9 aa, Homo sapiens
SMYDKVLML

SEQ ID NO: 2343 - protein, 9 aa, Homo sapiens
SVLGKIWKL

SEQ ID NO: 2344 - protein, 9 aa, Homo sapiens
TLAAAVPKI

SEQ ID NO: 2345 - protein, 9 aa, Homo sapiens
TLADVLYHV

SEQ ID NO: 2346 - protein, 10 aa, Homo sapiens
TLAEIAKVEL

SEQ ID NO: 2347 - protein, 9 aa, Homo sapiens
TLAQRVKEV

SEQ ID NO: 2348 - protein, 9 aa, Homo sapiens
TLDAGNIKL

SEQ ID NO: 2349 - protein, 9 aa, Homo sapiens
TLDDKKVYL

SEQ ID NO: 2350 - protein, 9 aa, Homo sapiens
TLDEKIEKV

SEQ ID NO: 2351 - protein, 9 aa, Homo sapiens
TLDEYTTRV

SEQ ID NO: 2352 - protein, 9 aa, Homo sapiens
TLDITPHTV

SEQ ID NO: 2353 - protein, 9 aa, Homo sapiens
TLFDYEVRL

SEQ ID NO: 2354 - protein, 9 aa, Homo sapiens
TLFTKELVL

SEQ ID NO: 2355 - protein, 9 aa, Homo sapiens
TLHRETFYL

SEQ ID NO: 2356 - protein, 11 aa, Homo sapiens
TLIDLPGITKV

SEQ ID NO: 2357 - protein, 9 aa, Homo sapiens
TLIEELKTL

SEQ ID NO: 2358 - protein, 10 aa, Homo sapiens
TLITDGMRSV

SEQ ID NO: 2359 - protein, 9 aa, Homo sapiens
TLLDRMVHL

SEQ ID NO: 2360 - protein, 10 aa, Homo sapiens
TLLDSPYARV

SEQ ID NO: 2361 - protein, 10 aa, Homo sapiens
TLLEDGTFKV

SEQ ID NO: 2362 - protein, 9 aa, Homo sapiens
TLLERAFSL

SEQ ID NO: 2363 - protein, 9 aa, Homo sapiens
TLLGHEFVL

SEQ ID NO: 2364 - protein, 9 aa, Homo sapiens
TLLGHLDYI

SEQ ID NO: 2365 - protein, 9 aa, Homo sapiens
TLLIQVPRI

SEQ ID NO: 2366 - protein, 9 aa, Homo sapiens
TLLNVIKSV

SEQ ID NO: 2367 - protein, 9 aa, Homo sapiens
TLLSNIQGV

SEQ ID NO: 2368 - protein, 9 aa, Homo sapiens
TLLVVVPKL

SEQ ID NO: 2369 - protein, 9 aa, Homo sapiens
TLMERTVSL

SEQ ID NO: 2370 - protein, 9 aa, Homo sapiens
TLNDREYQL

SEQ ID NO: 2371 - protein, 9 aa, Homo sapiens
TLNEKLFLL

SEQ ID NO: 2372 - protein, 9 aa, Homo sapiens
TLQEQLEKA

SEQ ID NO: 2373 - protein, 10 aa, Homo sapiens
TLQKEGVIGV

SEQ ID NO: 2374 - protein, 9 aa, Homo sapiens
TLSERLWGL

SEQ ID NO: 2375 - protein, 9 aa, Homo sapiens
TLSFMNPRL

SEQ ID NO: 2376 - protein, 11 aa, Homo sapiens
TLVQSTLTLQL

SEQ ID NO: 2377 - protein, 9 aa, Homo sapiens
TLVYHVVGV

SEQ ID NO: 2378 - protein, 11 aa, Homo sapiens
TLYDIAHTPGV

SEQ ID NO: 2379 - protein, 9 aa, Homo sapiens
TLYEAVREV

SEQ ID NO: 2380 - protein, 11 aa, Homo sapiens
TMAKESSIIGV

SEQ ID NO: 2381 - protein, 9 aa, Homo sapiens
TMVDRIEEV

SEQ ID NO: 2382 - protein, 9 aa, Herpes simplex virus (type 1 / strain 17)
TMYYKDVTV

SEQ ID NO: 2383 - protein, 12 aa, Homo sapiens
TTGAGNPVGDKL

SEQ ID NO: 2384 - protein, 9 aa, Homo sapiens
TVADKIHSV

SEQ ID NO: 2385 - protein, 9 aa, Homo sapiens
TVLGKIWKL

SEQ ID NO: 2386 - protein, 9 aa, Homo sapiens
TVMDEIHTV

SEQ ID NO: 2387 - protein, 10 aa, Homo sapiens
VIDKFGSDII

SEQ ID NO: 2388 - protein, 9 aa, Homo sapiens
VIIEKTYSL

SEQ ID NO: 2389 - protein, 9 aa, Homo sapiens
VIIPLLHTV

SEQ ID NO: 2390 - protein, 10 aa, Homo sapiens
VILEGELERA

SEQ ID NO: 2391 - protein, 9 aa, Homo sapiens
VIMDRAPSV

SEQ ID NO: 2392 - protein, 9 aa, Homo sapiens
VIMKSSPEV

SEQ ID NO: 2393 - protein, 9 aa, Homo sapiens
VIWGKVTRA

SEQ ID NO: 2394 - protein, 9 aa, Homo sapiens
VLADALKSI

SEQ ID NO: 2395 - protein, 9 aa, Homo sapiens
VLADLKVQL

SEQ ID NO: 2396 - protein, 9 aa, Homo sapiens
VLADQEVRL

SEQ ID NO: 2397 - protein, 9 aa, Homo sapiens
VLAEQLHQA

SEQ ID NO: 2398 - protein, 9 aa, Homo sapiens
VLAHTILGV

SEQ ID NO: 2399 - protein, 10 aa, Homo sapiens
VLAPLPLHGV

SEQ ID NO: 2400 - protein, 9 aa, Homo sapiens
VLDASVKEV

SEQ ID NO: 2401 - protein, 9 aa, Homo sapiens
VLDNVKMNL

SEQ ID NO: 2402 - protein, 9 aa, Homo sapiens
VLDSVDVRL

SEQ ID NO: 2403 - protein, 10 aa, Homo sapiens
VLFEGRTVQL

SEQ ID NO: 2404 - protein, 9 aa, Homo sapiens
VLFGVETHV

SEQ ID NO: 2405 - protein, 9 aa, Homo sapiens
VLFHNLPSL

SEQ ID NO: 2406 - protein, 9 aa, Homo sapiens
VLFNKLTYL

SEQ ID NO: 2407 - protein, 9 aa, Homo sapiens
VLFTGVKEV

SEQ ID NO: 2408 - protein, 11 aa, Homo sapiens
VLGGKAFLEHL

SEQ ID NO: 2409 - protein, 9 aa, Homo sapiens
VLHKELPEV

SEQ ID NO: 2410 - protein, 9 aa, Homo sapiens
VLIDYQRNV

SEQ ID NO: 2411 - protein, 9 aa, Homo sapiens
VLIGHSYGV

SEQ ID NO: 2412 - protein, 9 aa, Homo sapiens
VLIPKLPQL

SEQ ID NO: 2413 - protein, 9 aa, Homo sapiens
VLLDGIHRV

SEQ ID NO: 2414 - protein, 12 aa, Homo sapiens
VLLDTANKKVFL

SEQ ID NO: 2415 - protein, 9 aa, Homo sapiens
VLLELQQHL

SEQ ID NO: 2416 - protein, 9 aa, Homo sapiens
VLLGHIFYV

SEQ ID NO: 2417 - protein, 9 aa, Homo sapiens
VLLGKVYVV

SEQ ID NO: 2418 - protein, 10 aa, Homo sapiens
VLLKARLVPA

SEQ ID NO: 2419 - protein, 11 aa, Homo sapiens
VLLSDSNLHDA

SEQ ID NO: 2420 - protein, 9 aa, Homo sapiens
VLLSIYPRV

SEQ ID NO: 2421 - protein, 9 aa, Homo sapiens
VLLSTIHEL

SEQ ID NO: 2422 - protein, 9 aa, Homo sapiens
VLLTGLHAV

SEQ ID NO: 2423 - protein, 9 aa, Homo sapiens
VLLTRLENV

SEQ ID NO: 2424 - protein, 9 aa, Homo sapiens
VLMDHILNL

SEQ ID NO: 2425 - protein, 9 aa, Homo sapiens
VLMDRLPSL

SEQ ID NO: 2426 - protein, 9 aa, Homo sapiens
VLMEKPDVV

SEQ ID NO: 2427 - protein, 9 aa, Homo sapiens
VLMEMSYRL

SEQ ID NO: 2428 - protein, 9 aa, Homo sapiens
VLMEYIRSL

SEQ ID NO: 2429 - protein, 9 aa, Homo sapiens
VLMKDVQEI

SEQ ID NO: 2430 - protein, 10 aa, Homo sapiens
VLMQDSRLYL

SEQ ID NO: 2431 - protein, 9 aa, Homo sapiens
VLNEYFHNV

SEQ ID NO: 2432 - protein, 9 aa, Homo sapiens
VLNNVVIHL

SEQ ID NO: 2433 - protein, 9 aa, Homo sapiens
VLQEKVPEI

SEQ ID NO: 2434 - protein, 9 aa, Homo sapiens
VLQGRLPAV

SEQ ID NO: 2435 - protein, 10 aa, Homo sapiens
VLQNLKGQYV

SEQ ID NO: 2436 - protein, 9 aa, Homo sapiens
VLQQHLETL

SEQ ID NO: 2437 - protein, 9 aa, Homo sapiens
VLSELAARL

SEQ ID NO: 2438 - protein, 12 aa, Homo sapiens
VLSPADKTNVKA

SEQ ID NO: 2439 - protein, 9 aa, Homo sapiens
VLSSRLAFA

SEQ ID NO: 2440 - protein, 9 aa, Homo sapiens
VLTEFTREV

SEQ ID NO: 2441 - protein, 9 aa, Homo sapiens
VLTEHSEEL

SEQ ID NO: 2442 - protein, 9 aa, Homo sapiens
VLTSEVHSV

SEQ ID NO: 2443 - protein, 11 aa, Homo sapiens
VLVDDDGIKVV

SEQ ID NO: 2444 - protein, 9 aa, Homo sapiens
VLVDQTTGL

SEQ ID NO: 2445 - protein, 9 aa, Homo sapiens
VLVDRTIYI

SEQ ID NO: 2446 - protein, 11 aa, Homo sapiens
VLVEDSNNHHL

SEQ ID NO: 2447 - protein, 9 aa, Homo sapiens
VLVESEHQV

SEQ ID NO: 2448 - protein, 10 aa, Homo sapiens
VLVPGHLQSV

SEQ ID NO: 2449 - protein, 9 aa, Homo sapiens
VLWDRTFSL

SEQ ID NO: 2450 - protein, 9 aa, Homo sapiens
VLWGETVHL

SEQ ID NO: 2451 - protein, 9 aa, Homo sapiens
VLYDQPRHV

SEQ ID NO: 2452 - protein, 9 aa, Homo sapiens
VLYDRPLKI

SEQ ID NO: 2453 - protein, 9 aa, Homo sapiens
VLYEKDIQL

SEQ ID NO: 2454 - protein, 9 aa, Homo sapiens
VLYENKVAV

SEQ ID NO: 2455 - protein, 9 aa, Homo sapiens
VLYGKLVEA

SEQ ID NO: 2456 - protein, 10 aa, Homo sapiens
VLYGPKIDRA

SEQ ID NO: 2457 - protein, 9 aa, Homo sapiens
VLYHVETEV

SEQ ID NO: 2458 - protein, 10 aa, Homo sapiens
VLYPHEPTAV

SEQ ID NO: 2459 - protein, 9 aa, Homo sapiens
VLYTGDFRL

SEQ ID NO: 2460 - protein, 9 aa, Homo sapiens
VLYTGVVRV

SEQ ID NO: 2461 - protein, 10 aa, Homo sapiens
VMFGGKQVVV

SEQ ID NO: 2462 - protein, 9 aa, Homo sapiens
VMFNGKVYL

SEQ ID NO: 2463 - protein, 10 aa, Homo sapiens
VMFRTPLASV

SEQ ID NO: 2464 - protein, 8 aa, Homo sapiens
VMGKIFAV

SEQ ID NO: 2465 - protein, 10 aa, Homo sapiens
VMIAGKVAVV

SEQ ID NO: 2466 - protein, 9 aa, Homo sapiens
VMLEYVERA

SEQ ID NO: 2467 - protein, 9 aa, Homo sapiens
VMYGKVYRI

SEQ ID NO: 2468 - protein, 9 aa, Homo sapiens
VTLNKPQGL

SEQ ID NO: 2469 - protein, 9 aa, Homo sapiens
VTSLEKSLI

SEQ ID NO: 2470 - protein, 9 aa, Homo sapiens
WLAEKLPTL

SEQ ID NO: 2471 - protein, 9 aa, Homo sapiens
WLEENVHEV

SEQ ID NO: 2472 - protein, 11 aa, Homo sapiens
WLIEDGKVVTV

SEQ ID NO: 2473 - protein, 9 aa, Homo sapiens
WLVDHVYAI

SEQ ID NO: 2474 - protein, 9 aa, Human gammaherpesvirus 4
WQWEHIPPA

SEQ ID NO: 2475 - protein, 9 aa, Homo sapiens
YALNHTLSV

SEQ ID NO: 2476 - protein, 9 aa, Homo sapiens
YAYEKPHVV

SEQ ID NO: 2477 - protein, 9 aa, Homo sapiens
YGVKAGPGV

SEQ ID NO: 2478 - protein, 9 aa, Homo sapiens
YIAKITEGV

SEQ ID NO: 2479 - protein, 9 aa, Homo sapiens
YIFDNVAKV

SEQ ID NO: 2480 - protein, 10 aa, Homo sapiens
YIMDNKLAQI

SEQ ID NO: 2481 - protein, 9 aa, Homo sapiens
YIMSYISRV

SEQ ID NO: 2482 - protein, 9 aa, Homo sapiens
YIWDRHYNI

SEQ ID NO: 2483 - protein, 11 aa, Homo sapiens
YLADPAKFPEA

SEQ ID NO: 2484 - protein, 9 aa, Homo sapiens
YLAHAIHQV

SEQ ID NO: 2485 - protein, 9 aa, Homo sapiens
YLAKHIENI

SEQ ID NO: 2486 - protein, 9 aa, Herpes simplex virus (type 1 / strain 17)
YLANGGFLI

SEQ ID NO: 2487 - protein, 9 aa, Homo sapiens
YLAPFLRNV

SEQ ID NO: 2488 - protein, 9 aa, Homo sapiens
YLAPHVRTL

SEQ ID NO: 2489 - protein, 9 aa, Homo sapiens
YLASLIRSV

SEQ ID NO: 2490 - protein, 9 aa, Homo sapiens
YLDEIVKEV

SEQ ID NO: 2491 - protein, 9 aa, Homo sapiens
YLDEYIARM

SEQ ID NO: 2492 - protein, 9 aa, Homo sapiens
YLDFTNPKV

SEQ ID NO: 2493 - protein, 9 aa, Homo sapiens
YLDLSENRL

SEQ ID NO: 2494 - protein, 9 aa, Homo sapiens
YLDLSNNRL

SEQ ID NO: 2495 - protein, 9 aa, Homo sapiens
YLDPAQRGV

SEQ ID NO: 2496 - protein, 9 aa, Homo sapiens
YLDRFLAGV

SEQ ID NO: 2497 - protein, 11 aa, Homo sapiens
YLDVSVGKIVA

SEQ ID NO: 2498 - protein, 9 aa, Homo sapiens
YLDWTIERV

SEQ ID NO: 2499 - protein, 9 aa, Homo sapiens
YLEDKSYKL

SEQ ID NO: 2500 - protein, 9 aa, Homo sapiens
YLEEYKFQV

SEQ ID NO: 2501 - protein, 9 aa, Homo sapiens
YLEPYLKEV

SEQ ID NO: 2502 - protein, 10 aa, Homo sapiens
YLFAHAVDFV

SEQ ID NO: 2503 - protein, 9 aa, Homo sapiens
YLFERTFNL

SEQ ID NO: 2504 - protein, 9 aa, Homo sapiens
YLFREPATI

SEQ ID NO: 2505 - protein, 9 aa, Homo sapiens
YLFTSPQRV

SEQ ID NO: 2506 - protein, 9 aa, Homo sapiens
YLGPHIASV

SEQ ID NO: 2507 - protein, 8 aa, Homo sapiens
YLGQVTTI

SEQ ID NO: 2508 - protein, 9 aa, Homo sapiens
YLHNQGIGV

SEQ ID NO: 2509 - protein, 9 aa, Homo sapiens
YLHRQVAAV

SEQ ID NO: 2510 - protein, 9 aa, Homo sapiens
YLIDGTHKI

SEQ ID NO: 2511 - protein, 11 aa, Homo sapiens
YLISQVEGHQV

SEQ ID NO: 2512 - protein, 9 aa, Homo sapiens
YLITHPLAV

SEQ ID NO: 2513 - protein, 10 aa, Homo sapiens
YLLDHAPPEI

SEQ ID NO: 2514 - protein, 10 aa, Homo sapiens
YLLDKETLRL

SEQ ID NO: 2515 - protein, 9 aa, Homo sapiens
YLLDQHILI

SEQ ID NO: 2516 - protein, 9 aa, Homo sapiens
YLLEKSRAV

SEQ ID NO: 2517 - protein, 9 aa, Homo sapiens
YLLEKSRVI

SEQ ID NO: 2518 - protein, 9 aa, Homo sapiens
YLLESVNKL

SEQ ID NO: 2519 - protein, 9 aa, Homo sapiens
YLLGHDIRI

SEQ ID NO: 2520 - protein, 9 aa, Homo sapiens
YLLHEKLNL

SEQ ID NO: 2521 - protein, 10 aa, Homo sapiens
YLLLKGVEAV

SEQ ID NO: 2522 - protein, 9 aa, Homo sapiens
YLLLKTHQL

SEQ ID NO: 2523 - protein, 9 aa, Homo sapiens
YLLPFSKSI

SEQ ID NO: 2524 - protein, 11 aa, Homo sapiens
YLLPKDQGITL

SEQ ID NO: 2525 - protein, 10 aa, Homo sapiens
YLLQEPPRTV

SEQ ID NO: 2526 - protein, 9 aa, Homo sapiens
YLLQRAVEV

SEQ ID NO: 2527 - protein, 9 aa, Homo sapiens
YLLRSLDYV

SEQ ID NO: 2528 - protein, 9 aa, Homo sapiens
YLLTESSKL

SEQ ID NO: 2529 - protein, 10 aa, Homo sapiens
YLLTHPPPIM

SEQ ID NO: 2530 - protein, 9 aa, Homo sapiens
YLLTRNPHL

SEQ ID NO: 2531 - protein, 10 aa, Homo sapiens
YLMEGSYNKV

SEQ ID NO: 2532 - protein, 10 aa, Homo sapiens
YLMEQNVTKL

SEQ ID NO: 2533 - protein, 9 aa, Homo sapiens
YLMEVTHDL

SEQ ID NO: 2534 - protein, 9 aa, Homo sapiens
YLMVENIRL

SEQ ID NO: 2535 - protein, 9 aa, Homo sapiens
YLNDFTHEI

SEQ ID NO: 2536 - protein, 9 aa, Homo sapiens
YLNDLIHSV

SEQ ID NO: 2537 - protein, 9 aa, Homo sapiens
YLNDRVDEL

SEQ ID NO: 2538 - protein, 9 aa, Homo sapiens
YLNKEIEEA

SEQ ID NO: 2539 - protein, 9 aa, Homo sapiens
YLNQHIEHV

SEQ ID NO: 2540 - protein, 9 aa, Homo sapiens
YLNTRLFTV

SEQ ID NO: 2541 - protein, 11 aa, Homo sapiens
YLPDIIKDQKA

SEQ ID NO: 2542 - protein, 9 aa, Homo sapiens
YLPEDFIRV

SEQ ID NO: 2543 - protein, 9 aa, Homo sapiens
YLPSQVSRV

SEQ ID NO: 2544 - protein, 9 aa, Homo sapiens
YLPYPIHQV

SEQ ID NO: 2545 - protein, 9 aa, Homo sapiens
YLQAHTQSV

SEQ ID NO: 2546 - protein, 9 aa, Homo sapiens
YLQEHAQEV

SEQ ID NO: 2547 - protein, 9 aa, Homo sapiens
YLQEKLHAL

SEQ ID NO: 2548 - protein, 9 aa, Homo sapiens
YLQPKLLGI

SEQ ID NO: 2549 - protein, 9 aa, Homo sapiens
YLQQVNHKL

SEQ ID NO: 2550 - protein, 11 aa, Homo sapiens
YLRSVGDGETV

SEQ ID NO: 2551 - protein, 9 aa, Homo sapiens
YLSAVRATL

SEQ ID NO: 2552 - protein, 10 aa, Homo sapiens
YLSDIPLHDA

SEQ ID NO: 2553 - protein, 9 aa, Homo sapiens
YLSDNVHLV

SEQ ID NO: 2554 - protein, 9 aa, Homo sapiens
YLSKIIPAL

SEQ ID NO: 2555 - protein, 9 aa, Homo sapiens
YLSPDLSKV

SEQ ID NO: 2556 - protein, 9 aa, Homo sapiens
YLSPKLWAL

SEQ ID NO: 2557 - protein, 9 aa, Homo sapiens
YLSSLQPRL

SEQ ID NO: 2558 - protein, 9 aa, Homo sapiens
YLSVKVWDL

SEQ ID NO: 2559 - protein, 9 aa, Homo sapiens
YLTDRVMTV

SEQ ID NO: 2560 - protein, 10 aa, Homo sapiens
YLTNEGIQYL

SEQ ID NO: 2561 - protein, 9 aa, Homo sapiens
YLVAEKVTV

SEQ ID NO: 2562 - protein, 9 aa, Homo sapiens
YLVDFTQKI

SEQ ID NO: 2563 - protein, 9 aa, Homo sapiens
YLVEDIQHI

SEQ ID NO: 2564 - protein, 9 aa, Homo sapiens
YLWQGVRVA

SEQ ID NO: 2565 - protein, 9 aa, Homo sapiens
YLWRTSLYL

SEQ ID NO: 2566 - protein, 9 aa, Homo sapiens
YLYDLNHTL

SEQ ID NO: 2567 - protein, 9 aa, Homo sapiens
YLYGIRVEV

SEQ ID NO: 2568 - protein, 9 aa, Homo sapiens
YLYPDITRL

SEQ ID NO: 2569 - protein, 9 aa, Homo sapiens
YLYTKEQLL

SEQ ID NO: 2570 - protein, 9 aa, Homo sapiens
YMADRLLGV

SEQ ID NO: 2571 - protein, 11 aa, Homo sapiens
YMGEEKLIASV

SEQ ID NO: 2572 - protein, 9 aa, Homo sapiens
YMLEHVITL

SEQ ID NO: 2573 - protein, 9 aa, Homo sapiens
YMLGLEARL

SEQ ID NO: 2574 - protein, 9 aa, Homo sapiens
YMNHIMVSV

SEQ ID NO: 2575 - protein, 9 aa, Homo sapiens
YMYEKESEL

SEQ ID NO: 2576 - protein, 9 aa, Homo sapiens
YQYPVIIHL

SEQ ID NO: 2577 - protein, 9 aa, Homo sapiens
YTTDRVMTV

SEQ ID NO: 2578 - protein, 10 aa, Homo sapiens
YTYDEAIHSV

SEQ ID NO: 2579 - protein, 10 aa, Homo sapiens
YVFEGKMLEA

SEQ ID NO: 2580 - protein, 9 aa, Homo sapiens
YVFPGVTRL

SEQ ID NO: 2581 - protein, 11 aa, Homo sapiens
YVIDPIKGLKL

SEQ ID NO: 2582 - protein, 9 aa, Homo sapiens
YVLEGLKSV

SEQ ID NO: 2583 - protein, 9 aa, Homo sapiens
YVLPEVSKV

SEQ ID NO: 2584 - protein, 9 aa, Homo sapiens
YVVPFVAKV

SEQ ID NO: 2585 - protein, 10 aa, Homo sapiens
YVYDKDIEQI

SEQ ID NO: 2586 - protein, 9 aa, Homo sapiens
ILAAFLHWL

SEQ ID NO: 2587 - protein, 9 aa, Homo sapiens
ILAKFAHWL

SEQ ID NO: 2588 - protein, 9 aa, Influenza A virus (A/Anhui/1-YK_RG134/2013(H7N9))
AIVDKNITL

SEQ ID NO: 2589 - protein, 10 aa, H7N9 subtype
IVDKNITLKA

SEQ ID NO: 2590 - protein, 9 aa, Homo sapiens
FLAPLVTEY

SEQ ID NO: 2591 - protein, 9 aa, Homo sapiens
ALLERGYSL

SEQ ID NO: 2592 - protein, 9 aa, Homo sapiens
FAHPYQYEL

SEQ ID NO: 2593 - protein, 9 aa, Homo sapiens
GLNKKPMSL

SEQ ID NO: 2594 - protein, 9 aa, Homo sapiens
KATAYILSV

SEQ ID NO: 2595 - protein, 9 aa, Homo sapiens
KLINSQISL

SEQ ID NO: 2596 - protein, 10 aa, Homo sapiens
KLPLPLPPRL

SEQ ID NO: 2597 - protein, 10 aa, Homo sapiens
KMAEVIGSKL

SEQ ID NO: 2598 - protein, 10 aa, Homo sapiens
KVCNPIITKL

SEQ ID NO: 2599 - protein, 11 aa, Homo sapiens
KVLDTIMATKL

SEQ ID NO: 2600 - protein, 10 aa, Homo sapiens
RLAEWKATKL

SEQ ID NO: 2601 - protein, 9 aa, Homo sapiens
RSIEKSNSV

SEQ ID NO: 2602 - protein, 9 aa, Homo sapiens
TLNEKLTAL

SEQ ID NO: 2603 - protein, 9 aa, Homo sapiens
VATEGSREL

SEQ ID NO: 2604 - protein, 9 aa, Homo sapiens
YANYYTREV

SEQ ID NO: 2605 - protein, 10 aa, Homo sapiens
AIYDHINEGV

SEQ ID NO: 2606 - protein, 10 aa, Homo sapiens
AIYDHVNEGV

SEQ ID NO: 2607 - protein, 9 aa, Homo sapiens
ALAPAPAEV

SEQ ID NO: 2608 - protein, 9 aa, Homo sapiens
ALAPAPVEV

SEQ ID NO: 2609 - protein, 11 aa, Homo sapiens
ASEAIKGAVVG

SEQ ID NO: 2610 - protein, 9 aa, Homo sapiens
ATIGVLLDL

SEQ ID NO: 2611 - protein, 9 aa, Homo sapiens
DTAPPRDSW

SEQ ID NO: 2612 - protein, 10 aa, Artificial Sequence
  unknown
FVAGTQEVFV

SEQ ID NO: 2613 - protein, 11 aa, Homo sapiens
GLLGQEGLVEI

SEQ ID NO: 2614 - protein, 11 aa, Homo sapiens
GLPGQEGLVEI

SEQ ID NO: 2615 - protein, 11 aa, Homo sapiens
GQSELASRLTL

SEQ ID NO: 2616 - protein, 11 aa, Homo sapiens
IAVGYVDDTQF

SEQ ID NO: 2617 - protein, 10 aa, Homo sapiens
ILFPDIIARA

SEQ ID NO: 2618 - protein, 11 aa, Homo sapiens
LRVAPEEHPVL

SEQ ID NO: 2619 - protein, 11 aa, Homo sapiens
MLAPEAVILVM

SEQ ID NO: 2620 - protein, 9 aa, Homo sapiens
MLDPLEVHL

SEQ ID NO: 2621 - protein, 9 aa, Homo sapiens
MVLTRIIAI

SEQ ID NO: 2622 - protein, 8 aa, Homo sapiens
PELLLLPL

SEQ ID NO: 2623 - protein, 9 aa, Homo sapiens
PLLLLLLGL

SEQ ID NO: 2624 - protein, 9 aa, Homo sapiens
SLPKHSVTI

SEQ ID NO: 2625 - protein, 9 aa, Homo sapiens
SQYPFPVTL

SEQ ID NO: 2626 - protein, 11 aa, Homo sapiens
SVAEGRALMSV

SEQ ID NO: 2627 - protein, 9 aa, Homo sapiens
TAALFIILL

SEQ ID NO: 2628 - protein, 9 aa, Homo sapiens
TEWIKAIQM

SEQ ID NO: 2629 - protein, 9 aa, Artificial Sequence
  Unknown
TFLKIIPML

SEQ ID NO: 2630 - protein, 9 aa, Homo sapiens
TLLKQLKEA

SEQ ID NO: 2631 - protein, 9 aa, Artificial Sequence
  unknwon
TQIHSMVNL

SEQ ID NO: 2632 - protein, 8 aa, Homo sapiens
VLDELVRP

SEQ ID NO: 2633 - protein, 9 aa, Homo sapiens
YTLILKTIL

SEQ ID NO: 2634 - protein, 9 aa, Homo sapiens
FLPEAPAEL

SEQ ID NO: 2635 - protein, 9 aa, Homo sapiens
FYDERIVVV

SEQ ID NO: 2636 - protein, 8 aa, Homo sapiens
LSDHHIYL

SEQ ID NO: 2637 - protein, 9 aa, Homo sapiens
MVDGKPVNL

SEQ ID NO: 2638 - protein, 9 aa, Homo sapiens
SFDGIIAMM

SEQ ID NO: 2639 - protein, 9 aa, Homo sapiens
VFDEAIRAV

SEQ ID NO: 2640 - protein, 10 aa, Homo sapiens
VFDEAIRAVL

SEQ ID NO: 2641 - protein, 9 aa, Homo sapiens
VFDPVPVGV

SEQ ID NO: 2642 - protein, 10 aa, Homo sapiens
VLDDKDYFLF

SEQ ID NO: 2643 - protein, 9 aa, Homo sapiens
YVQDYEDFM

SEQ ID NO: 2644 - protein, 10 aa, Homo sapiens
ALYVDSLFFL

SEQ ID NO: 2645 - protein, 9 aa, Human alphaherpesvirus 2
AKKLHFSTA

SEQ ID NO: 2646 - protein, 9 aa, Human alphaherpesvirus 2
FASPADPKV

SEQ ID NO: 2647 - protein, 9 aa, Human alphaherpesvirus 2
FVLVILARL

SEQ ID NO: 2648 - protein, 9 aa, Human alphaherpesvirus 2
TLVAHGPSL

SEQ ID NO: 2649 - protein, 9 aa, Mycobacterium tuberculosis
AAGNVNIAI

SEQ ID NO: 2650 - protein, 9 aa, Mycobacterium tuberculosis
AAMAAQLQA

SEQ ID NO: 2651 - protein, 9 aa, Mycobacterium tuberculosis
AAMASASLV

SEQ ID NO: 2652 - protein, 9 aa, Mycobacterium tuberculosis
AAQFNASPV

SEQ ID NO: 2653 - protein, 9 aa, Mycobacterium tuberculosis
ALNATDPGA

SEQ ID NO: 2654 - protein, 9 aa, Mycobacterium tuberculosis
ALSAGVGAV

SEQ ID NO: 2655 - protein, 9 aa, Mycobacterium tuberculosis
AMAAQLQAV

SEQ ID NO: 2656 - protein, 9 aa, Mycobacterium tuberculosis
AMASASLVT

SEQ ID NO: 2657 - protein, 9 aa, Mycobacterium tuberculosis
APPPQRAAM

SEQ ID NO: 2658 - protein, 9 aa, Mycobacterium tuberculosis
AQFNASPVA

SEQ ID NO: 2659 - protein, 9 aa, Mycobacterium tuberculosis
AQLQAVPGA

SEQ ID NO: 2660 - protein, 9 aa, Mycobacterium tuberculosis
AQSYLRNFL

SEQ ID NO: 2661 - protein, 9 aa, Mycobacterium tuberculosis
ASPPSTAAA

SEQ ID NO: 2662 - protein, 9 aa, Mycobacterium tuberculosis
GAAQYIGLV

SEQ ID NO: 2663 - protein, 9 aa, Mycobacterium tuberculosis
GAASGPKVV

SEQ ID NO: 2664 - protein, 9 aa, Mycobacterium tuberculosis
GLGNVNGVT

SEQ ID NO: 2665 - protein, 9 aa, Mycobacterium tuberculosis
GWVESDAAH

SEQ ID NO: 2666 - protein, 9 aa, Mycobacterium tuberculosis
GYTSGTGQG

SEQ ID NO: 2667 - protein, 9 aa, Homo sapiens
ILLLSLNPV

SEQ ID NO: 2668 - protein, 9 aa, Mycobacterium tuberculosis
LAAPPPQRA

SEQ ID NO: 2669 - protein, 9 aa, Mycobacterium tuberculosis
LAESIRPLV

SEQ ID NO: 2670 - protein, 9 aa, Mycobacterium tuberculosis
LAIAAMASA

SEQ ID NO: 2671 - protein, 9 aa, Homo sapiens
LLMPTISLI

SEQ ID NO: 2672 - protein, 9 aa, Mycobacterium tuberculosis
LTDGNPPEV

SEQ ID NO: 2673 - protein, 9 aa, Mycobacterium tuberculosis
MASASLVTV

SEQ ID NO: 2674 - protein, 9 aa, Homo sapiens
MLTTLILTL

SEQ ID NO: 2675 - protein, 9 aa, Mycobacterium tuberculosis
MSLTVGAGV

SEQ ID NO: 2676 - protein, 9 aa, Mycobacterium tuberculosis
NAPPPPVIA

SEQ ID NO: 2677 - protein, 9 aa, Homo sapiens
PLLIPTSKL

SEQ ID NO: 2678 - protein, 9 aa, Mycobacterium tuberculosis
PNAPPPPVI

SEQ ID NO: 2679 - protein, 9 aa, Mycobacterium tuberculosis
RLDQKLYAS

SEQ ID NO: 2680 - protein, 9 aa, Mycobacterium tuberculosis
RLSLTALSA

SEQ ID NO: 2681 - protein, 9 aa, Mycobacterium tuberculosis
SASLVTVAV

SEQ ID NO: 2682 - protein, 9 aa, Homo sapiens
SLNPWPPCL

SEQ ID NO: 2683 - protein, 9 aa, Mycobacterium tuberculosis
SLTALSAGV

SEQ ID NO: 2684 - protein, 9 aa, Mycobacterium tuberculosis
TTGDPPFPG

SEQ ID NO: 2685 - protein, 9 aa, Mycobacterium tuberculosis
VAPPPPAAA

SEQ ID NO: 2686 - protein, 9 aa, Mycobacterium tuberculosis
VTGSVVCTT

SEQ ID NO: 2687 - protein, 9 aa, Mycobacterium tuberculosis
VTLGYTSGT

SEQ ID NO: 2688 - protein, 9 aa, Mycobacterium tuberculosis
WLGTANNPV

SEQ ID NO: 2689 - protein, 9 aa, Bacillus pumilus YLFTLLVPL <2690;PRT;Mycobacterium tuberculosis
YLRNFLAAP

SEQ ID NO: 2690 - protein, 9 aa, Mycobacterium tuberculosis
YMPYPGTRI

SEQ ID NO: 2691 - protein, 9 aa, Homo sapiens
YVFTLLVPL

SEQ ID NO: 2692 - protein, 9 aa, Homo sapiens
YVFTLLVSL

SEQ ID NO: 2693 - protein, 10 aa, Homo sapiens
FLMSSWWPNL

SEQ ID NO: 2694 - protein, 10 aa, Homo sapiens
KLCKVRKITV

SEQ ID NO: 2695 - protein, 10 aa, Homo sapiens
NLLDSLEQYI

SEQ ID NO: 2696 - protein, 9 aa, Homo sapiens
VLLRHSKNV

SEQ ID NO: 2697 - protein, 9 aa, Homo sapiens
VLTSESMHV

SEQ ID NO: 2698 - protein, 9 aa, Homo sapiens
VVPEDYWGV

SEQ ID NO: 2699 - protein, 9 aa, Homo sapiens
WLDEVKQAL

SEQ ID NO: 2700 - protein, 9 aa, Human alphaherpesvirus 3
ILIEGIFFV

SEQ ID NO: 2701 - protein, 9 aa, Human alphaherpesvirus 2
ILIEGVFFA

SEQ ID NO: 2702 - protein, 10 aa, Human alphaherpesvirus 3
MILIEGIFFV

SEQ ID NO: 2703 - protein, 9 aa, Hepatitis B virus
FLGGPPVCL

SEQ ID NO: 2704 - protein, 9 aa, Hepatitis B virus
FLKQQYMNL

SEQ ID NO: 2705 - protein, 9 aa, Hepatitis B virus
FLSKQYMDL

SEQ ID NO: 2706 - protein, 9 aa, Hepatitis B virus
GGPNLDNIL

SEQ ID NO: 2707 - protein, 9 aa, Hepatitis B virus
ILRSFIPLL

SEQ ID NO: 2708 - protein, 11 aa, Hepatitis B virus
LTFGRETVLEN

SEQ ID NO: 2709 - protein, 11 aa, Hepatitis B virus
LTTVPAASLLA

SEQ ID NO: 2710 - protein, 9 aa, Hepatitis B virus
TVSTKLCKI

SEQ ID NO: 2711 - protein, 11 aa, Homo sapiens
FAYDGKDYLTL

SEQ ID NO: 2712 - protein, 10 aa, Hepatitis C virus genotype 1
IMAKNEVFCV

SEQ ID NO: 2713 - protein, 9 aa, Hepatitis C virus genotype 1
MLVCGDDLV

SEQ ID NO: 2714 - protein, 9 aa, Hepatitis C virus genotype 1
SVIDCNTCV

SEQ ID NO: 2715 - protein, 9 aa, Hepatitis C virus genotype 1
YLFNWAVRT

SEQ ID NO: 2716 - protein, 9 aa, Hepatitis C virus genotype 1
YVGDLCGSV

SEQ ID NO: 2717 - protein, 10 aa, Hepatitis C virus subtype 1b
QLSGLGINAV

SEQ ID NO: 2718 - protein, 9 aa, Yellow fever virus 17D
SMSMILVGV

SEQ ID NO: 2719 - protein, 9 aa, Homo sapiens
FLDGNELTL

SEQ ID NO: 2720 - protein, 9 aa, Yellow fever virus 17D
FLDPASIAA

SEQ ID NO: 2721 - protein, 9 aa, Homo sapiens
FLLQDTVEL

SEQ ID NO: 2722 - protein, 9 aa, Homo sapiens
HLIDYLVTS

SEQ ID NO: 2723 - protein, 9 aa, Homo sapiens
HLSTAFARV

SEQ ID NO: 2724 - protein, 9 aa, Yellow fever virus 17D
ILNDSGETV

SEQ ID NO: 2725 - protein, 9 aa, Homo sapiens
KLLEPVLLL

SEQ ID NO: 2726 - protein, 9 aa, Homo sapiens
LLIENVASL

SEQ ID NO: 2727 - protein, 9 aa, Yellow fever virus 17D
SMQKTIPLV

SEQ ID NO: 2728 - protein, 9 aa, Homo sapiens
SMSADVPLV

SEQ ID NO: 2729 - protein, 9 aa, Homo sapiens
GIGTDEKML

SEQ ID NO: 2730 - protein, 9 aa, Homo sapiens
GLSEFTEYL

SEQ ID NO: 2731 - protein, 9 aa, Homo sapiens
LLHYLLDAV

SEQ ID NO: 2732 - protein, 9 aa, Homo sapiens
NLVKCQVEL

SEQ ID NO: 2733 - protein, 9 aa, Homo sapiens
SLKYFHTSV

SEQ ID NO: 2734 - protein, 9 aa, Homo sapiens
SVLGRIWKL

SEQ ID NO: 2735 - protein, 9 aa, Homo sapiens
AAPAYSRAL

SEQ ID NO: 2736 - protein, 10 aa, Homo sapiens
HLPETKFSEL

SEQ ID NO: 2737 - protein, 9 aa, Homo sapiens
AAANIIRTL

SEQ ID NO: 2738 - protein, 9 aa, Homo sapiens
AADTERLAL

SEQ ID NO: 2739 - protein, 9 aa, Homo sapiens
AAVRIGSVL

SEQ ID NO: 2740 - protein, 10 aa, Homo sapiens
AVGLVLPAKL

SEQ ID NO: 2741 - protein, 10 aa, Homo sapiens
AVKKNPGIAA

SEQ ID NO: 2742 - protein, 9 aa, Homo sapiens
DIELQAENI

SEQ ID NO: 2743 - protein, 9 aa, Homo sapiens
DLDVKKMPL

SEQ ID NO: 2744 - protein, 9 aa, Homo sapiens
ELNKLLEEI

SEQ ID NO: 2745 - protein, 11 aa, Homo sapiens
FLDPDIGGVAV

SEQ ID NO: 2746 - protein, 9 aa, Homo sapiens
FLKDLVASV

SEQ ID NO: 2747 - protein, 9 aa, Homo sapiens
FMYDRPLRL

SEQ ID NO: 2748 - protein, 9 aa, Homo sapiens
FSITKSVEL

SEQ ID NO: 2749 - protein, 9 aa, Homo sapiens
FSTPHGLEV

SEQ ID NO: 2750 - protein, 10 aa, Homo sapiens
GAAVRIGSVL

SEQ ID NO: 2751 - protein, 10 aa, Homo sapiens
GVIDGHIYAV

SEQ ID NO: 2752 - protein, 9 aa, Homo sapiens
ILDEKPVII

SEQ ID NO: 2753 - protein, 9 aa, Homo sapiens
ISMKILNSL

SEQ ID NO: 2754 - protein, 9 aa, Homo sapiens
KIASQLSKL

SEQ ID NO: 2755 - protein, 10 aa, Homo sapiens
KITVPASQKL

SEQ ID NO: 2756 - protein, 9 aa, Homo sapiens
KLDNQVSKV

SEQ ID NO: 2757 - protein, 10 aa, Homo sapiens
LIYSVGLLLA

SEQ ID NO: 2758 - protein, 9 aa, Homo sapiens
LSEQTSVPL

SEQ ID NO: 2759 - protein, 9 aa, Homo sapiens
LTLGEFLKL

SEQ ID NO: 2760 - protein, 9 aa, Homo sapiens
MIFRSGSLI

SEQ ID NO: 2761 - protein, 10 aa, Homo sapiens
NVSSRFEEEI

SEQ ID NO: 2762 - protein, 9 aa, Homo sapiens
QLLDQVEQI

SEQ ID NO: 2763 - protein, 9 aa, Homo sapiens
RISEVLQKL

SEQ ID NO: 2764 - protein, 12 aa, Homo sapiens
SIEPAKETTTNV

SEQ ID NO: 2765 - protein, 9 aa, Homo sapiens
SILEDPPSI

SEQ ID NO: 2766 - protein, 9 aa, Homo sapiens
SMTSLAQKI

SEQ ID NO: 2767 - protein, 8 aa, Homo sapiens
TLGEFLKL

SEQ ID NO: 2768 - protein, 9 aa, Homo sapiens
TVIYRIQAL

SEQ ID NO: 2769 - protein, 10 aa, Homo sapiens
VLFGGKVSGA

SEQ ID NO: 2770 - protein, 9 aa, Homo sapiens
VLYENALKL

SEQ ID NO: 2771 - protein, 9 aa, Homo sapiens
VMLDVPIRL

SEQ ID NO: 2772 - protein, 15 aa, Homo sapiens
GALNSVLTLMCMGAL

SEQ ID NO: 2773 - protein, 16 aa, Homo sapiens
GVAGIGILTGMCMGVG

SEQ ID NO: 2774 - protein, 15 aa, Homo sapiens
GVLNSVLTLMCMGVL

SEQ ID NO: 2775 - protein, 10 aa, Homo sapiens
LLFGLALIEV

SEQ ID NO: 2776 - protein, 15 aa, Homo sapiens
SAAGIGILTVMCMSA

SEQ ID NO: 2777 - protein, 14 aa, Homo sapiens
SLLNSVLTLMCMSL

SEQ ID NO: 2778 - protein, 9 aa, Hepatitis C virus subtype 1a
FLVGQLFTF

SEQ ID NO: 2779 - protein, 12 aa, Homo sapiens
ALADLDELLIRA

SEQ ID NO: 2780 - protein, 12 aa, Homo sapiens
ALADLIEKELSV

SEQ ID NO: 2781 - protein, 12 aa, Homo sapiens
ALFDGHGGPAAA

SEQ ID NO: 2782 - protein, 12 aa, Homo sapiens
ALFDQTRHSLAL

SEQ ID NO: 2783 - protein, 12 aa, Homo sapiens
ALIDEGETDWKL

SEQ ID NO: 2784 - protein, 12 aa, Homo sapiens
ALISLGEGLITA

SEQ ID NO: 2785 - protein, 12 aa, Homo sapiens
ALLDQALSNARL

SEQ ID NO: 2786 - protein, 12 aa, Homo sapiens
ALLEDLGKASGL

SEQ ID NO: 2787 - protein, 12 aa, Homo sapiens
ALLETPQRLFAL

SEQ ID NO: 2788 - protein, 12 aa, Homo sapiens
ALMDSLGPEWRL

SEQ ID NO: 2789 - protein, 12 aa, Homo sapiens
ALMDVGNMGQSV

SEQ ID NO: 2790 - protein, 12 aa, Homo sapiens
ALWDIETGQQTT

SEQ ID NO: 2791 - protein, 12 aa, Homo sapiens
ALWDLAADKQTL

SEQ ID NO: 2792 - protein, 12 aa, Homo sapiens
ALYDVGDIVHSV

SEQ ID NO: 2793 - protein, 12 aa, Homo sapiens
AMIDEGETDWKV

SEQ ID NO: 2794 - protein, 12 aa, Homo sapiens
AMLPDLQPLEKL

SEQ ID NO: 2795 - protein, 12 aa, Homo sapiens
AMVNIPEEMLRV

SEQ ID NO: 2796 - protein, 9 aa, Hepatitis C virus
CINGVVWTV

SEQ ID NO: 2797 - protein, 12 aa, Homo sapiens
FILDISPVAHRV

SEQ ID NO: 2798 - protein, 12 aa, Homo sapiens
FIMDDPAGNSYL

SEQ ID NO: 2799 - protein, 12 aa, Homo sapiens
FLADPDTVNHLL

SEQ ID NO: 2800 - protein, 12 aa, Homo sapiens
FLDELEDEAKAA

SEQ ID NO: 2801 - protein, 12 aa, Homo sapiens
FLDSMASGTLHL

SEQ ID NO: 2802 - protein, 12 aa, Homo sapiens
FLFQAGSGIYHV

SEQ ID NO: 2803 - protein, 12 aa, Homo sapiens
FLIEEQKIVVKV

SEQ ID NO: 2804 - protein, 12 aa, Homo sapiens
FLLQDSGRILQL

SEQ ID NO: 2805 - protein, 12 aa, Homo sapiens
FLNLMEKLNENI

SEQ ID NO: 2806 - protein, 12 aa, Homo sapiens
FLWAGGRASYGV

SEQ ID NO: 2807 - protein, 12 aa, Homo sapiens
FLYDEIEAEVNL

SEQ ID NO: 2808 - protein, 12 aa, Homo sapiens
FLYQQQGRLDKL

SEQ ID NO: 2809 - protein, 12 aa, Homo sapiens
FVILRKNPNYDL

SEQ ID NO: 2810 - protein, 12 aa, Homo sapiens
GLAPAEVVVATV

SEQ ID NO: 2811 - protein, 12 aa, Homo sapiens
GLFGGSSKIEEA

SEQ ID NO: 2812 - protein, 12 aa, Homo sapiens
GLLDPNVKSIFV

SEQ ID NO: 2813 - protein, 12 aa, Homo sapiens
GLLDQDTGLVLL

SEQ ID NO: 2814 - protein, 12 aa, Homo sapiens
GLVDDFEKKFNA

SEQ ID NO: 2815 - protein, 12 aa, Homo sapiens
HLWEVDVQGSKA

SEQ ID NO: 2816 - protein, 12 aa, Homo sapiens
ILFSEDSTKLFV

SEQ ID NO: 2817 - protein, 12 aa, Homo sapiens
ILLDGDKGKFLL

SEQ ID NO: 2818 - protein, 12 aa, Homo sapiens
ILMKDLADELAL

SEQ ID NO: 2819 - protein, 12 aa, Homo sapiens
KIFDIDEAEEGV

SEQ ID NO: 2820 - protein, 12 aa, Homo sapiens
KLADEVITRNEL

SEQ ID NO: 2821 - protein, 12 aa, Homo sapiens
KLFVDTDADTRL

SEQ ID NO: 2822 - protein, 12 aa, Homo sapiens
KLIDDQDISISL

SEQ ID NO: 2823 - protein, 14 aa, Homo sapiens
  misc_feature (13)..(13): Xaa can be any naturally occurring amino acid
KLIDLSQVMYLVXM

SEQ ID NO: 2824 - protein, 12 aa, Homo sapiens
KLIGDTPIDTFL

SEQ ID NO: 2825 - protein, 12 aa, Homo sapiens
KLIPQLPTLENL

SEQ ID NO: 2826 - protein, 12 aa, Homo sapiens
KLLDLETERILL

SEQ ID NO: 2827 - protein, 12 aa, Homo sapiens
KLLDPEDVAVQL

SEQ ID NO: 2828 - protein, 12 aa, Homo sapiens
KLLEGEEERLKL

SEQ ID NO: 2829 - protein, 12 aa, Homo sapiens
KLLEGEEERLRL

SEQ ID NO: 2830 - protein, 12 aa, Homo sapiens
KLLEGEESRISL

SEQ ID NO: 2831 - protein, 12 aa, Homo sapiens
KLLNQENIESEL

SEQ ID NO: 2832 - protein, 12 aa, Homo sapiens
KLMDLDVEQLGI

SEQ ID NO: 2833 - protein, 12 aa, Homo sapiens
KLMEVEKEKQEL

SEQ ID NO: 2834 - protein, 12 aa, Homo sapiens
KLMNVDPDSVVL

SEQ ID NO: 2835 - protein, 12 aa, Homo sapiens
KLQDLTDVQIMA

SEQ ID NO: 2836 - protein, 12 aa, Homo sapiens
KLSDIGEGIREV

SEQ ID NO: 2837 - protein, 12 aa, Homo sapiens
KLVSEKLASYQA

SEQ ID NO: 2838 - protein, 14 aa, Homo sapiens
  misc_feature (13)..(13): Xaa can be any naturally occurring amino acid
KLWDISEVMVGLXM

SEQ ID NO: 2839 - protein, 14 aa, Homo sapiens
  misc_feature (13)..(13): Xaa can be any naturally occurring amino acid
KLWEMDNMLIQIXM

SEQ ID NO: 2840 - protein, 12 aa, Homo sapiens
KLWEVSSGELLL

SEQ ID NO: 2841 - protein, 12 aa, Homo sapiens
KLYDIDVAKVNT

SEQ ID NO: 2842 - protein, 12 aa, Homo sapiens
KLYEIGAGTSEV

SEQ ID NO: 2843 - protein, 12 aa, Homo sapiens
KMFQEEGYIIAV

SEQ ID NO: 2844 - protein, 12 aa, Homo sapiens
KVWDLFPEADKV

SEQ ID NO: 2845 - protein, 12 aa, Homo sapiens
LLAGGSLAFILL

SEQ ID NO: 2846 - protein, 12 aa, Homo sapiens
LLLDPDTAVLKL

SEQ ID NO: 2847 - protein, 12 aa, Homo sapiens
LLLESDPKVYSL

SEQ ID NO: 2848 - protein, 12 aa, Homo sapiens
LLYDLADQLHAA

SEQ ID NO: 2849 - protein, 12 aa, Homo sapiens
LLYDLVTEKMFA

SEQ ID NO: 2850 - protein, 12 aa, Homo sapiens
LLYDQTKAPPFV

SEQ ID NO: 2851 - protein, 12 aa, Homo sapiens
LLYPLERGFIYV

SEQ ID NO: 2852 - protein, 12 aa, Homo sapiens
LMWELEKKSAVA

SEQ ID NO: 2853 - protein, 9 aa, Dengue virus 1
MVLALITFL

SEQ ID NO: 2854 - protein, 12 aa, Homo sapiens
NLDDENIRTSDV

SEQ ID NO: 2855 - protein, 12 aa, Homo sapiens
NLFDLGGQYLRV

SEQ ID NO: 2856 - protein, 12 aa, Homo sapiens
NLIDAGVDALRV

SEQ ID NO: 2857 - protein, 12 aa, Homo sapiens
NLIDLDDLYVHL

SEQ ID NO: 2858 - protein, 12 aa, Homo sapiens
NLLIDDKGTIKL

SEQ ID NO: 2859 - protein, 12 aa, Homo sapiens
QLWEYDPVKLTL

SEQ ID NO: 2860 - protein, 12 aa, Homo sapiens
RLAELTVDEFLA

SEQ ID NO: 2861 - protein, 12 aa, Homo sapiens
RLLDLENSLLGL

SEQ ID NO: 2862 - protein, 12 aa, Homo sapiens
RLLDMGETDLML

SEQ ID NO: 2863 - protein, 12 aa, Homo sapiens
RLLDSVEQDFHL

SEQ ID NO: 2864 - protein, 12 aa, Homo sapiens
RLLEITEGSEFL

SEQ ID NO: 2865 - protein, 12 aa, Homo sapiens
RLLPDTINSINL

SEQ ID NO: 2866 - protein, 12 aa, Homo sapiens
RLYDPTEGMVSV

SEQ ID NO: 2867 - protein, 12 aa, Homo sapiens
RLYDVPANSMRL

SEQ ID NO: 2868 - protein, 12 aa, Homo sapiens
RLYSEDELPAEF

SEQ ID NO: 2869 - protein, 12 aa, Homo sapiens
RMFDQQEIQVLI

SEQ ID NO: 2870 - protein, 12 aa, Homo sapiens
RVLDPSMVILEV

SEQ ID NO: 2871 - protein, 12 aa, Homo sapiens
SILEIQKGVFEV

SEQ ID NO: 2872 - protein, 12 aa, Homo sapiens
SLAELDEKISAL

SEQ ID NO: 2873 - protein, 12 aa, Homo sapiens
SLFDGFADGLGV

SEQ ID NO: 2874 - protein, 12 aa, Homo sapiens
SLFDYHDTRIHV

SEQ ID NO: 2875 - protein, 12 aa, Homo sapiens
SLFGNSGILENV

SEQ ID NO: 2876 - protein, 12 aa, Homo sapiens
SLLDENNVSSYL

SEQ ID NO: 2877 - protein, 12 aa, Homo sapiens
SLLDMSLVKLQL

SEQ ID NO: 2878 - protein, 12 aa, Homo sapiens
SLLEQGKEPWMV

SEQ ID NO: 2879 - protein, 12 aa, Homo sapiens
SLNDLEKDVMLL

SEQ ID NO: 2880 - protein, 12 aa, Homo sapiens
SLVDGRIIDTSL

SEQ ID NO: 2881 - protein, 12 aa, Homo sapiens
SLYDWNVKLLKV

SEQ ID NO: 2882 - protein, 12 aa, Homo sapiens
SQIDDLYSTIKV

SEQ ID NO: 2883 - protein, 12 aa, Homo sapiens
TLFDAETVALDA

SEQ ID NO: 2884 - protein, 12 aa, Homo sapiens
TLFDHAPDKLSV

SEQ ID NO: 2885 - protein, 12 aa, Homo sapiens
TLIDEDVYRLWL

SEQ ID NO: 2886 - protein, 12 aa, Homo sapiens
TLMEESGKMIFL

SEQ ID NO: 2887 - protein, 14 aa, Homo sapiens
  misc_feature (13)..(13): Xaa can be any naturally occurring amino acid
TLMQLLAVTVAVXM

SEQ ID NO: 2888 - protein, 12 aa, Homo sapiens
TLSDEHAGVISV

SEQ ID NO: 2889 - protein, 12 aa, Homo sapiens
TLWDIQKDLKDL

SEQ ID NO: 2890 - protein, 12 aa, Homo sapiens
VLAEINKEIEGV

SEQ ID NO: 2891 - protein, 12 aa, Homo sapiens
VLAEVAGILEPV

SEQ ID NO: 2892 - protein, 12 aa, Homo sapiens
VLFDSESIGIYV

SEQ ID NO: 2893 - protein, 12 aa, Homo sapiens
VLFNFGKEKFEV

SEQ ID NO: 2894 - protein, 12 aa, Homo sapiens
VLFNIDGQGNHV

SEQ ID NO: 2895 - protein, 12 aa, Homo sapiens
VLLDEESRPVNL

SEQ ID NO: 2896 - protein, 12 aa, Homo sapiens
VLLDLPSISSQV

SEQ ID NO: 2897 - protein, 14 aa, Homo sapiens
  misc_feature (13)..(13): Xaa can be any naturally occurring amino acid
VLLDVSAGQLLMXM

SEQ ID NO: 2898 - protein, 12 aa, Homo sapiens
VLLEAGEGLVTI

SEQ ID NO: 2899 - protein, 12 aa, Homo sapiens
VLLPQETAEIHL

SEQ ID NO: 2900 - protein, 12 aa, Homo sapiens
VLTLASNAIILI

SEQ ID NO: 2901 - protein, 12 aa, Homo sapiens
VLVDLPGVINTV

SEQ ID NO: 2902 - protein, 12 aa, Homo sapiens
VLVTEKGGLVEV

SEQ ID NO: 2903 - protein, 12 aa, Homo sapiens
VLWDRTFSLFQQ

SEQ ID NO: 2904 - protein, 12 aa, Homo sapiens
VLYNEEKQKMYM

SEQ ID NO: 2905 - protein, 14 aa, Homo sapiens
  misc_feature (13)..(13): Xaa can be any naturally occurring amino acid
YLFDVQRNNIAMXM

SEQ ID NO: 2906 - protein, 12 aa, Homo sapiens
YLFPEEFKAIYL

SEQ ID NO: 2907 - protein, 12 aa, Homo sapiens
YLIEPDVELQRI

SEQ ID NO: 2908 - protein, 12 aa, Homo sapiens
YLLDQPVLEQRL

SEQ ID NO: 2909 - protein, 12 aa, Homo sapiens
YLMDTSGKVVTA

SEQ ID NO: 2910 - protein, 12 aa, Homo sapiens
YLMEGSYNKVFL

SEQ ID NO: 2911 - protein, 12 aa, Homo sapiens
YLWDLDHGFAGV

SEQ ID NO: 2912 - protein, 12 aa, Homo sapiens
YPRDASPANTGL

SEQ ID NO: 2913 - protein, 12 aa, Homo sapiens
YVLEGKELEFYL

SEQ ID NO: 2914 - protein, 11 aa, Homo sapiens
RVAPEEHPVLL

SEQ ID NO: 2915 - protein, 9 aa, Homo sapiens
IIEPSLRQL

SEQ ID NO: 2916 - protein, 9 aa, Homo sapiens
IIFETPLRV

SEQ ID NO: 2917 - protein, 10 aa, Homo sapiens
KLADFGLARL

SEQ ID NO: 2918 - protein, 9 aa, Homo sapiens
RIMEFTTTL

SEQ ID NO: 2919 - protein, 11 aa, Homo sapiens
VILRKNPNYDL

SEQ ID NO: 2920 - protein, 10 aa, Homo sapiens
VLISLKQAPL

SEQ ID NO: 2921 - protein, 9 aa, Influenza A virus (A/Puerto Rico/8/1934(H1N1))
FLDIWTYNA

SEQ ID NO: 2922 - protein, 9 aa, Influenza A virus (A/Puerto Rico/8/1934(H1N1))
ILPDMTPSI

SEQ ID NO: 2923 - protein, 9 aa, Trypanosoma cruzi strain CL Brener
AAAGDKLSL

SEQ ID NO: 2924 - protein, 10 aa, Trypanosoma cruzi
ALQVTNHRYL

SEQ ID NO: 2925 - protein, 9 aa, Trypanosoma cruzi
ALRNLRVFL

SEQ ID NO: 2926 - protein, 10 aa, Trypanosoma cruzi
TVFDASRSTV

SEQ ID NO: 2927 - protein, 9 aa, Mycobacterium tuberculosis
AIIIAVLLV

SEQ ID NO: 2928 - protein, 9 aa, Mycobacterium tuberculosis
ALAIIIAVL

SEQ ID NO: 2929 - protein, 9 aa, Nocardia transvalensis
AAAPPPVRR

SEQ ID NO: 2930 - protein, 9 aa, Artificial Sequence
  unknown
ALFPQLVIL

SEQ ID NO: 2931 - protein, 9 aa, Artificial Sequence
  unknown
ALLPPINIL

SEQ ID NO: 2932 - protein, 11 aa, Artificial Sequence
  unknown
ILAPPVVKLLV

SEQ ID NO: 2933 - protein, 9 aa, Artificial Sequence
  unknown
KLIKPIVMK

SEQ ID NO: 2934 - protein, 9 aa, Artificial Sequence
  unknown
KQALKYFNL

SEQ ID NO: 2935 - protein, 11 aa, Homo sapiens
LLLDVPTAAVQ

SEQ ID NO: 2936 - protein, 8 aa, Homo sapiens
LLPAIVHI

SEQ ID NO: 2937 - protein, 12 aa, Homo sapiens
PGVTVKDVNQQE

SEQ ID NO: 2938 - protein, 9 aa, Homo sapiens
PQPDVFPLF

SEQ ID NO: 2939 - protein, 11 aa, Homo sapiens
RLPEVEVPQHL

SEQ ID NO: 2940 - protein, 9 aa, Artificial Sequence
  unknown
SLLGLLVEV

SEQ ID NO: 2941 - protein, 9 aa, Homo sapiens
SYIEHIFEI

SEQ ID NO: 2942 - protein, 9 aa, Artificial Sequence
  unknown
TLIKIQHTL

SEQ ID NO: 2943 - protein, 9 aa, Homo sapiens
TYLEKAIKI

SEQ ID NO: 2944 - protein, 11 aa, Homo sapiens
VLMTQQPRPVL

SEQ ID NO: 2945 - protein, 9 aa, Homo sapiens
VLPAFTSNL

SEQ ID NO: 2946 - protein, 9 aa, Homo sapiens
VLPKLYVKL

SEQ ID NO: 2947 - protein, 9 aa, Homo sapiens
VYSPHVLNL

SEQ ID NO: 2948 - protein, 9 aa, Mycobacterium tuberculosis H37Ra
AAAAGWQTL

SEQ ID NO: 2949 - protein, 10 aa, Mycobacterium tuberculosis H37Ra
ALAAATPMVV

SEQ ID NO: 2950 - protein, 9 aa, Mycobacterium tuberculosis H37Ra
ALAMEVYQA

SEQ ID NO: 2951 - protein, 9 aa, Mycobacterium tuberculosis H37Ra
ALDAQAVEL

SEQ ID NO: 2952 - protein, 9 aa, Mycobacterium tuberculosis H37Ra
ALTEMDYFI

SEQ ID NO: 2953 - protein, 9 aa, Mycobacterium tuberculosis H37Ra
AMPPELNTA

SEQ ID NO: 2954 - protein, 9 aa, Mycobacterium tuberculosis H37Ra
ELTARLNSL

SEQ ID NO: 2955 - protein, 10 aa, Mycobacterium tuberculosis H37Ra
FIRMWNQAAL

SEQ ID NO: 2956 - protein, 9 aa, Mycobacterium tuberculosis H37Ra
GINTIPIAL

SEQ ID NO: 2957 - protein, 9 aa, Mycobacterium tuberculosis H37Ra
KLEPMASIL

SEQ ID NO: 2958 - protein, 10 aa, Mycobacterium tuberculosis H37Ra
LIEKPVAPSV

SEQ ID NO: 2959 - protein, 10 aa, Mycobacterium tuberculosis H37Ra
LLRAESLPGA

SEQ ID NO: 2960 - protein, 10 aa, Mycobacterium tuberculosis H37Ra
QLPPAATQTL

SEQ ID NO: 2961 - protein, 10 aa, Mycobacterium tuberculosis H37Ra
SLPEIAANHI

SEQ ID NO: 2962 - protein, 9 aa, Human betaherpesvirus 5
LQTGIHVRV

SEQ ID NO: 2963 - protein, 9 aa, Hepatitis C virus
RLGPVQNEV

SEQ ID NO: 2964 - protein, 9 aa, Hepatitis C virus
WLGNIIMFA

SEQ ID NO: 2965 - protein, 11 aa, Homo sapiens
ALKRQGRTLYG

SEQ ID NO: 2966 - protein, 9 aa, Homo sapiens
ILQKNVPIL

SEQ ID NO: 2967 - protein, 9 aa, Homo sapiens
MRYVASYLL

SEQ ID NO: 2968 - protein, 9 aa, Homo sapiens
RVAPEEHPV

SEQ ID NO: 2969 - protein, 9 aa, Homo sapiens
TADPLDYRL

SEQ ID NO: 2970 - protein, 8 aa, Homo sapiens
VIDEPVRL

SEQ ID NO: 2971 - protein, 9 aa, Homo sapiens
YVDRVTEFL

SEQ ID NO: 2972 - protein, 9 aa, Homo sapiens
AMLERQFTV

SEQ ID NO: 2973 - protein, 9 aa, Homo sapiens
FLSSANEHL

SEQ ID NO: 2974 - protein, 10 aa, Human betaherpesvirus 5
KMMYMCYRNI

SEQ ID NO: 2975 - protein, 10 aa, Human betaherpesvirus 5
KQMWQARLTV

SEQ ID NO: 2976 - protein, 9 aa, Homo sapiens
MMYKDILLL

SEQ ID NO: 2977 - protein, 9 aa, Homo sapiens
RLLEAIIRL

SEQ ID NO: 2978 - protein, 9 aa, Homo sapiens
SLAAYIPRL

SEQ ID NO: 2979 - protein, 9 aa, Homo sapiens
SLQEKVAKA

SEQ ID NO: 2980 - protein, 9 aa, Homo sapiens
VLQNVAFSV

SEQ ID NO: 2981 - protein, 10 aa, Hepatitis C virus
KLVAAGINAV

SEQ ID NO: 2982 - protein, 10 aa, Hepatitis C virus
KLVACGINAV

SEQ ID NO: 2983 - protein, 10 aa, Hepatitis C virus
KLVADGINAV

SEQ ID NO: 2984 - protein, 10 aa, Hepatitis C virus
KLVAEGINAV

SEQ ID NO: 2985 - protein, 10 aa, Hepatitis C virus
KLVAFGINAV

SEQ ID NO: 2986 - protein, 10 aa, Hepatitis C virus
KLVAGGINAV

SEQ ID NO: 2987 - protein, 10 aa, Hepatitis C virus
KLVAHGINAV

SEQ ID NO: 2988 - protein, 10 aa, Hepatitis C virus
KLVAIGINAV

SEQ ID NO: 2989 - protein, 10 aa, Hepatitis C virus
KLVAKGINAV

SEQ ID NO: 2990 - protein, 10 aa, Hepatitis C virus
KLVANGINAV

SEQ ID NO: 2991 - protein, 10 aa, Hepatitis C virus
KLVAPGINAV

SEQ ID NO: 2992 - protein, 10 aa, Hepatitis C virus
KLVAQGINAV

SEQ ID NO: 2993 - protein, 10 aa, Hepatitis C virus
KLVARGINAV

SEQ ID NO: 2994 - protein, 10 aa, Hepatitis C virus
KLVASGINAV

SEQ ID NO: 2995 - protein, 10 aa, Hepatitis C virus
KLVATGINAV

SEQ ID NO: 2996 - protein, 10 aa, Hepatitis C virus
KLVAVGINAV

SEQ ID NO: 2997 - protein, 10 aa, Hepatitis C virus
KLVAWGINAV

SEQ ID NO: 2998 - protein, 10 aa, Hepatitis C virus
KLVAYGINAV

SEQ ID NO: 2999 - protein, 9 aa, Human immunodeficiency virus 1
YTAFTIPSV

SEQ ID NO: 3000 - protein, 9 aa, Homo sapiens
ALAPGLPTA

SEQ ID NO: 3001 - protein, 9 aa, Homo sapiens
DVHGPDWHL

SEQ ID NO: 3002 - protein, 10 aa, Homo sapiens
FVYDEPGHAV

SEQ ID NO: 3003 - protein, 9 aa, Homo sapiens
MLFPGSIAL

SEQ ID NO: 3004 - protein, 9 aa, Homo sapiens
MVAPAVASV

SEQ ID NO: 3005 - protein, 9 aa, Homo sapiens
NLLPKLHIV

SEQ ID NO: 3006 - protein, 9 aa, Homo sapiens
NVDPDNVVL

SEQ ID NO: 3007 - protein, 9 aa, Homo sapiens
SLASLLVSV

SEQ ID NO: 3008 - protein, 9 aa, Homo sapiens
SLLDPVPEV

SEQ ID NO: 3009 - protein, 9 aa, Homo sapiens
SLYGGTITI

SEQ ID NO: 3010 - protein, 9 aa, Homo sapiens
VLGTAIVEA

SEQ ID NO: 3011 - protein, 10 aa, Homo sapiens
FLVDGVCTVC

SEQ ID NO: 3012 - protein, 9 aa, Homo sapiens
KVVDVVRNL

SEQ ID NO: 3013 - protein, 12 aa, Homo sapiens
  misc_feature (11)..(11): Xaa can be any naturally occurring amino acid
LVLCLLSATVXC

SEQ ID NO: 3014 - protein, 15 aa, Homo sapiens
STCLLPHIEAVSCMC

SEQ ID NO: 3015 - protein, 15 aa, Homo sapiens
STCLVKIINEVSCMC

SEQ ID NO: 3016 - protein, 13 aa, Homo sapiens
  misc_feature (12)..(12): Xaa can be any naturally occurring amino acid
YLFDRNGVCLHXH

SEQ ID NO: 3017 - protein, 9 aa, Hepatitis C virus genotype 1
DLPLIIQRL

SEQ ID NO: 3018 - protein, 9 aa, Hepatitis C virus genotype 3
GILVLFGFF

SEQ ID NO: 3019 - protein, 9 aa, Hepatitis C virus genotype 3
IMGGELPTA

SEQ ID NO: 3020 - protein, 9 aa, Hepatitis C virus genotype 1
IMSGEVPSM

SEQ ID NO: 3021 - protein, 10 aa, Hepatitis C virus genotype 1
KLVALGLNAV

SEQ ID NO: 3022 - protein, 10 aa, Homo sapiens
QLFNKHTMFI

SEQ ID NO: 3023 - protein, 10 aa, Homo sapiens
LLLHCPSKTV

SEQ ID NO: 3024 - protein, 9 aa, Mycobacterium tuberculosis
YLRNFLAAP

SEQ ID NO: 3025 - protein, 10 aa, Hepatitis C virus genotype 1
QMAMIKLGAL

SEQ ID NO: 3026 - protein, 10 aa, Hepatitis C virus genotype 1
SSVSTALAEL

SEQ ID NO: 3027 - protein, 10 aa, Hepatitis C virus genotype 1
VLFGLMALTL

SEQ ID NO: 3028 - protein, 10 aa, Hepatitis C virus genotype 1
VLTESSVSTA

SEQ ID NO: 3029 - protein, 9 aa, Hepatitis C virus genotype 1
VVLFGLMAL

SEQ ID NO: 3030 - protein, 9 aa, Homo sapiens
HLAVERGKV

SEQ ID NO: 3031 - protein, 10 aa, Artificial Sequence
  unknown
LLMEHTMVAF

SEQ ID NO: 3032 - protein, 9 aa, Homo sapiens
RLASYLDRV

SEQ ID NO: 3033 - protein, 10 aa, Homo sapiens
TLFPGKVHSL

SEQ ID NO: 3034 - protein, 11 aa, Toxoplasma gondii ME49
VLFDKATYDKL

SEQ ID NO: 3035 - protein, 9 aa, Homo sapiens
FLMPFPVNY

SEQ ID NO: 3036 - protein, 12 aa, Homo sapiens
GKADGAEAKPAE

SEQ ID NO: 3037 - protein, 9 aa, Homo sapiens
GLWGHALLL

SEQ ID NO: 3038 - protein, 11 aa, Homo sapiens
HAVYRDDLKKL

SEQ ID NO: 3039 - protein, 10 aa, Homo sapiens
KIYDREQTRY

SEQ ID NO: 3040 - protein, 10 aa, Homo sapiens
LDTNADKQLS

SEQ ID NO: 3041 - protein, 9 aa, Homo sapiens
RMYELVHRM

SEQ ID NO: 3042 - protein, 10 aa, Homo sapiens
SLADAINTEF

SEQ ID NO: 3043 - protein, 9 aa, Homo sapiens
SLYEGIDFY

SEQ ID NO: 3044 - protein, 9 aa, Homo sapiens
YLLDHFLSM

SEQ ID NO: 3045 - protein, 11 aa, Homo sapiens
FTDEEGYGRYL

SEQ ID NO: 3046 - protein, 12 aa, Homo sapiens
QLERPGGLDTLY

SEQ ID NO: 3047 - protein, 9 aa, Homo sapiens
ALMELFPKL

SEQ ID NO: 3048 - protein, 12 aa, Homo sapiens
FILPDSLPLDTL

SEQ ID NO: 3049 - protein, 10 aa, Homo sapiens
GLIDSLVHYV

SEQ ID NO: 3050 - protein, 9 aa, Homo sapiens
LLIDDEYKV

SEQ ID NO: 3051 - protein, 11 aa, Homo sapiens
SLADDSVLERL

SEQ ID NO: 3052 - protein, 9 aa, Homo sapiens
SLLDLHTKV

SEQ ID NO: 3053 - protein, 11 aa, Homo sapiens
TIAEVGKWLQA

SEQ ID NO: 3054 - protein, 9 aa, Homo sapiens
TLFNVIKSV

SEQ ID NO: 3055 - protein, 12 aa, Homo sapiens
WQVKSGTIFDNF

SEQ ID NO: 3056 - protein, 9 aa, Homo sapiens
YYLNDLERI

SEQ ID NO: 3057 - protein, 10 aa, Human betaherpesvirus 5
QARLTVSGLA

SEQ ID NO: 3058 - protein, 9 aa, Homo sapiens
RQFPTPFQL

SEQ ID NO: 3059 - protein, 8 aa, Homo sapiens
VREIAQDF

SEQ ID NO: 3060 - protein, 10 aa, Homo sapiens
AGFAGDDAPR

SEQ ID NO: 3061 - protein, 11 aa, Homo sapiens
AGLAPYKLRPV

SEQ ID NO: 3062 - protein, 10 aa, Homo sapiens
AILEKSDFTM

SEQ ID NO: 3063 - protein, 9 aa, Homo sapiens
AILEKVFTA

SEQ ID NO: 3064 - protein, 9 aa, Homo sapiens
AIQDKLFQV

SEQ ID NO: 3065 - protein, 9 aa, Homo sapiens
ALAEEVEQV

SEQ ID NO: 3066 - protein, 9 aa, Homo sapiens
ALAPGVRAV

SEQ ID NO: 3067 - protein, 9 aa, Homo sapiens
ALDEVFTKV

SEQ ID NO: 3068 - protein, 11 aa, Homo sapiens
ALEEPDDQNRI

SEQ ID NO: 3069 - protein, 11 aa, Homo sapiens
ALFDEQHREEM

SEQ ID NO: 3070 - protein, 9 aa, Homo sapiens
ALFKEAYSL

SEQ ID NO: 3071 - protein, 9 aa, Homo sapiens
ALFQHITAL

SEQ ID NO: 3072 - protein, 8 aa, Homo sapiens
ALGFVYKL

SEQ ID NO: 3073 - protein, 9 aa, Homo sapiens
ALGHRLDIV

SEQ ID NO: 3074 - protein, 9 aa, Homo sapiens
ALHDHLATI

SEQ ID NO: 3075 - protein, 9 aa, Homo sapiens
ALHDRAPQL

SEQ ID NO: 3076 - protein, 9 aa, Homo sapiens
ALIEDEHNL

SEQ ID NO: 3077 - protein, 9 aa, Homo sapiens
ALKDFVASI

SEQ ID NO: 3078 - protein, 9 aa, Homo sapiens
ALLDNNIGL

SEQ ID NO: 3079 - protein, 10 aa, Homo sapiens
ALLEKGITEA

SEQ ID NO: 3080 - protein, 9 aa, Homo sapiens
ALLETNPYL

SEQ ID NO: 3081 - protein, 9 aa, Homo sapiens
ALLPLLERV

SEQ ID NO: 3082 - protein, 10 aa, Homo sapiens
ALMAHAMEEV

SEQ ID NO: 3083 - protein, 9 aa, Homo sapiens
ALMDQVHHM

SEQ ID NO: 3084 - protein, 9 aa, Homo sapiens
ALMEAVSHA

SEQ ID NO: 3085 - protein, 9 aa, Homo sapiens
ALMPVLNQV

SEQ ID NO: 3086 - protein, 10 aa, Homo sapiens
ALNPVANFHL

SEQ ID NO: 3087 - protein, 9 aa, Homo sapiens
ALPENPPAI

SEQ ID NO: 3088 - protein, 11 aa, Homo sapiens
ALPGDNVGFNV

SEQ ID NO: 3089 - protein, 9 aa, Homo sapiens
ALQDRVPLA

SEQ ID NO: 3090 - protein, 9 aa, Homo sapiens
ALSDHHVYL

SEQ ID NO: 3091 - protein, 9 aa, Homo sapiens
ALSDSIHTV

SEQ ID NO: 3092 - protein, 9 aa, Homo sapiens
ALSGHLETV

SEQ ID NO: 3093 - protein, 9 aa, Homo sapiens
ALTDFVRSV

SEQ ID NO: 3094 - protein, 10 aa, Homo sapiens
ALVDQRELYL

SEQ ID NO: 3095 - protein, 9 aa, Homo sapiens
ALYEQSLHI

SEQ ID NO: 3096 - protein, 9 aa, Homo sapiens
ALYSAEHGL

SEQ ID NO: 3097 - protein, 9 aa, Homo sapiens
AMAFITDHV

SEQ ID NO: 3098 - protein, 12 aa, Homo sapiens
AMFDQSQIQEFK

SEQ ID NO: 3099 - protein, 9 aa, Homo sapiens
ATDPTIHTV

SEQ ID NO: 3100 - protein, 9 aa, Homo sapiens
AVMLHSFTL

SEQ ID NO: 3101 - protein, 10 aa, Homo sapiens
DTNADKQLSF

SEQ ID NO: 3102 - protein, 12 aa, Homo sapiens
FFISEPLFKLSL

SEQ ID NO: 3103 - protein, 9 aa, Homo sapiens
FIAQKILAL

SEQ ID NO: 3104 - protein, 9 aa, Homo sapiens
FILEKEGYV

SEQ ID NO: 3105 - protein, 9 aa, Homo sapiens
FILPKEIAV

SEQ ID NO: 3106 - protein, 9 aa, Homo sapiens
FIMDRAQAL

SEQ ID NO: 3107 - protein, 9 aa, Homo sapiens
FLADIVQKL

SEQ ID NO: 3108 - protein, 9 aa, Homo sapiens
FLADNHHQV

SEQ ID NO: 3109 - protein, 10 aa, Homo sapiens
FLAEDALNTV

SEQ ID NO: 3110 - protein, 9 aa, Homo sapiens
FLAKLIAQA

SEQ ID NO: 3111 - protein, 10 aa, Homo sapiens
FLALLAGAHA

SEQ ID NO: 3112 - protein, 9 aa, Homo sapiens
FLDEKTHEL

SEQ ID NO: 3113 - protein, 11 aa, Homo sapiens
FLDESRSTQYM

SEQ ID NO: 3114 - protein, 10 aa, Homo sapiens
FLFDEEMEQM

SEQ ID NO: 3115 - protein, 9 aa, Homo sapiens
FLFNTENKL

SEQ ID NO: 3116 - protein, 9 aa, Homo sapiens
FLGPWPAAS

SEQ ID NO: 3117 - protein, 9 aa, Homo sapiens
FLGSNTPHV

SEQ ID NO: 3118 - protein, 9 aa, Homo sapiens
FLHEATVRL

SEQ ID NO: 3119 - protein, 9 aa, Homo sapiens
FLIQEIKTL

SEQ ID NO: 3120 - protein, 10 aa, Homo sapiens
FLLDGFPRTV

SEQ ID NO: 3121 - protein, 11 aa, Homo sapiens
FLLDKPQDLSI

SEQ ID NO: 3122 - protein, 11 aa, Homo sapiens
FLLEQEKTQAL

SEQ ID NO: 3123 - protein, 9 aa, Homo sapiens
FLMELEQPA

SEQ ID NO: 3124 - protein, 10 aa, Homo sapiens
FLNPDEVHAI

SEQ ID NO: 3125 - protein, 11 aa, Homo sapiens
FLPDPSALQNL

SEQ ID NO: 3126 - protein, 9 aa, Homo sapiens
FLQELNEKM

SEQ ID NO: 3127 - protein, 8 aa, Homo sapiens
FLSKTEEL

SEQ ID NO: 3128 - protein, 9 aa, Homo sapiens
FLSTSIAQL

SEQ ID NO: 3129 - protein, 9 aa, Homo sapiens
FLTDTSHLL

SEQ ID NO: 3130 - protein, 11 aa, Homo sapiens
FLWNGSGPQGL

SEQ ID NO: 3131 - protein, 9 aa, Artificial Sequence
  unknown
FLYDTHQDL

SEQ ID NO: 3132 - protein, 8 aa, Homo sapiens
FLYKVVQV

SEQ ID NO: 3133 - protein, 9 aa, Homo sapiens
FLYPFPLAL

SEQ ID NO: 3134 - protein, 10 aa, Homo sapiens
FLYPLVGTMS

SEQ ID NO: 3135 - protein, 12 aa, Homo sapiens
FMDEEEEDEIRV

SEQ ID NO: 3136 - protein, 9 aa, Homo sapiens
FMLNQNVML

SEQ ID NO: 3137 - protein, 9 aa, Homo sapiens
FMLTQPHSV

SEQ ID NO: 3138 - protein, 10 aa, Homo sapiens
FQAGSGIYHV

SEQ ID NO: 3139 - protein, 8 aa, Homo sapiens
FQAMNKEL

SEQ ID NO: 3140 - protein, 9 aa, Homo sapiens
FQHGVIAAV

SEQ ID NO: 3141 - protein, 9 aa, Homo sapiens
FQHTGIYSV

SEQ ID NO: 3142 - protein, 8 aa, Homo sapiens
FQSETKNL

SEQ ID NO: 3143 - protein, 10 aa, Homo sapiens
FVDKTVLPFV

SEQ ID NO: 3144 - protein, 9 aa, Homo sapiens
FVIETARQL

SEQ ID NO: 3145 - protein, 11 aa, Homo sapiens
FVLKTPSAAYL

SEQ ID NO: 3146 - protein, 11 aa, Homo sapiens
GIAEEPEIQMV

SEQ ID NO: 3147 - protein, 12 aa, Homo sapiens
GIVEFSGKPAAR

SEQ ID NO: 3148 - protein, 9 aa, Homo sapiens
GLAEDSPKM

SEQ ID NO: 3149 - protein, 9 aa, Homo sapiens
GLAERISVL

SEQ ID NO: 3150 - protein, 9 aa, Homo sapiens
GLAKAVASV

SEQ ID NO: 3151 - protein, 9 aa, Homo sapiens
GLAKSIHHA

SEQ ID NO: 3152 - protein, 10 aa, Homo sapiens
GLALQGIYKA

SEQ ID NO: 3153 - protein, 10 aa, Homo sapiens
GLAPYKLRPV

SEQ ID NO: 3154 - protein, 9 aa, Homo sapiens
GLFPAPIHV

SEQ ID NO: 3155 - protein, 9 aa, Homo sapiens
GLGQLGFHV

SEQ ID NO: 3156 - protein, 9 aa, Homo sapiens
GLIDHQTYL

SEQ ID NO: 3157 - protein, 11 aa, Homo sapiens
GLIDTKELEPL

SEQ ID NO: 3158 - protein, 10 aa, Homo sapiens
GLIGVGLINV

SEQ ID NO: 3159 - protein, 9 aa, Homo sapiens
GLKEGIPAL

SEQ ID NO: 3160 - protein, 9 aa, Homo sapiens
GLKNGVPAV

SEQ ID NO: 3161 - protein, 11 aa, Homo sapiens
GLLDNDEIMAL

SEQ ID NO: 3162 - protein, 9 aa, Homo sapiens
GLLGVTQQL

SEQ ID NO: 3163 - protein, 10 aa, Homo sapiens
GLLQPPVRIV

SEQ ID NO: 3164 - protein, 9 aa, Homo sapiens
GLLTEIRAV

SEQ ID NO: 3165 - protein, 9 aa, Homo sapiens
GLMADPMKV

SEQ ID NO: 3166 - protein, 9 aa, Homo sapiens
GLNDFIQKI

SEQ ID NO: 3167 - protein, 9 aa, Homo sapiens
GLNDRSDAV

SEQ ID NO: 3168 - protein, 9 aa, Homo sapiens
GLQEAQYRL

SEQ ID NO: 3169 - protein, 9 aa, Homo sapiens
GLQEHSISV

SEQ ID NO: 3170 - protein, 9 aa, Homo sapiens
GLTEALHFV

SEQ ID NO: 3171 - protein, 9 aa, Homo sapiens
GLTPHLTMV

SEQ ID NO: 3172 - protein, 11 aa, Homo sapiens
GLTSTDLLFHL

SEQ ID NO: 3173 - protein, 11 aa, Homo sapiens
GLVDEKALAQA

SEQ ID NO: 3174 - protein, 10 aa, Homo sapiens
GLVKEGLVMV

SEQ ID NO: 3175 - protein, 11 aa, Homo sapiens
GLWEIENNPTV

SEQ ID NO: 3176 - protein, 11 aa, Homo sapiens
GLYSLSSVVTV

SEQ ID NO: 3177 - protein, 9 aa, Homo sapiens
GVYGDVHRV

SEQ ID NO: 3178 - protein, 9 aa, Homo sapiens
HLAPRTPEV

SEQ ID NO: 3179 - protein, 9 aa, Homo sapiens
HLGPEGRSV

SEQ ID NO: 3180 - protein, 9 aa, Homo sapiens
HLLHTVPAL

SEQ ID NO: 3181 - protein, 9 aa, Homo sapiens
HLNPHTNMV

SEQ ID NO: 3182 - protein, 9 aa, Homo sapiens
HLWTGEEQL

SEQ ID NO: 3183 - protein, 9 aa, Homo sapiens
HVLDVIHEV

SEQ ID NO: 3184 - protein, 10 aa, Homo sapiens
IAVGYVDDTQ

SEQ ID NO: 3185 - protein, 9 aa, Homo sapiens
IIDQHTFEV

SEQ ID NO: 3186 - protein, 9 aa, Homo sapiens
IILDEAHNV

SEQ ID NO: 3187 - protein, 9 aa, Homo sapiens
IILGKSHYV

SEQ ID NO: 3188 - protein, 10 aa, Homo sapiens
IKKIGYNPDT

SEQ ID NO: 3189 - protein, 12 aa, Homo sapiens
IKKIGYNPDTVA

SEQ ID NO: 3190 - protein, 11 aa, Homo sapiens
ILAELPEDFKA

SEQ ID NO: 3191 - protein, 11 aa, Homo sapiens
ILAPAGSLPKI

SEQ ID NO: 3192 - protein, 9 aa, Homo sapiens
ILATNTQKV

SEQ ID NO: 3193 - protein, 11 aa, Homo sapiens
ILENPPEEMKL

SEQ ID NO: 3194 - protein, 9 aa, Homo sapiens
ILIDKTSFV

SEQ ID NO: 3195 - protein, 9 aa, Homo sapiens
ILIDPIRVV

SEQ ID NO: 3196 - protein, 9 aa, Homo sapiens
ILLAEVPTM

SEQ ID NO: 3197 - protein, 9 aa, Homo sapiens
ILQPHVIAL

SEQ ID NO: 3198 - protein, 9 aa, Homo sapiens
ILQTKLYTL

SEQ ID NO: 3199 - protein, 11 aa, Toxoplasma gondii ME49
IMQLLRDNLTL

SEQ ID NO: 3200 - protein, 9 aa, Homo sapiens
IMYDQNHLL

SEQ ID NO: 3201 - protein, 10 aa, Homo sapiens
INDPFIDLNY

SEQ ID NO: 3202 - protein, 11 aa, Homo sapiens
IQDNHDGTYTV

SEQ ID NO: 3203 - protein, 9 aa, Homo sapiens
IQSSHNFQL

SEQ ID NO: 3204 - protein, 9 aa, Homo sapiens
IQVTKVTQV

SEQ ID NO: 3205 - protein, 9 aa, Homo sapiens
IRKLPFQRL

SEQ ID NO: 3206 - protein, 9 aa, Homo sapiens
IVDRPVTLV

SEQ ID NO: 3207 - protein, 9 aa, Homo sapiens
KFWESPETV

SEQ ID NO: 3208 - protein, 9 aa, Homo sapiens
KIAPNTPQL

SEQ ID NO: 3209 - protein, 9 aa, Homo sapiens
KILPTLEAV

SEQ ID NO: 3210 - protein, 9 aa, Homo sapiens
KIQEILTQV

SEQ ID NO: 3211 - protein, 10 aa, Homo sapiens
KIWDVSVNSV

SEQ ID NO: 3212 - protein, 9 aa, Homo sapiens
KIYEKTFTL

SEQ ID NO: 3213 - protein, 9 aa, Homo sapiens
KLADAKIFL

SEQ ID NO: 3214 - protein, 9 aa, Homo sapiens
KLADQYPHL

SEQ ID NO: 3215 - protein, 9 aa, Homo sapiens
KLDAFVEGV

SEQ ID NO: 3216 - protein, 9 aa, Homo sapiens
KLFGETTLV

SEQ ID NO: 3217 - protein, 9 aa, Homo sapiens
KLFIGGLNV

SEQ ID NO: 3218 - protein, 10 aa, Homo sapiens
KLGDFGLATV

SEQ ID NO: 3219 - protein, 9 aa, Homo sapiens
KLGNAPAEV

SEQ ID NO: 3220 - protein, 9 aa, Homo sapiens
KLGSVPVTV

SEQ ID NO: 3221 - protein, 9 aa, Homo sapiens
KLHYVVTEV

SEQ ID NO: 3222 - protein, 11 aa, Homo sapiens
KLIDETQDMLL

SEQ ID NO: 3223 - protein, 9 aa, Homo sapiens
KLIEEVHAV

SEQ ID NO: 3224 - protein, 9 aa, Homo sapiens
KLIESTSTM

SEQ ID NO: 3225 - protein, 9 aa, Homo sapiens
KLIKSLEAA

SEQ ID NO: 3226 - protein, 10 aa, Homo sapiens
KLLDPEDISV

SEQ ID NO: 3227 - protein, 9 aa, Homo sapiens
KLLGELHTL

SEQ ID NO: 3228 - protein, 9 aa, Homo sapiens
KLLGKVTIA

SEQ ID NO: 3229 - protein, 9 aa, Homo sapiens
KLLGNIKNV

SEQ ID NO: 3230 - protein, 9 aa, Homo sapiens
KLLQFYPSL

SEQ ID NO: 3231 - protein, 9 aa, Homo sapiens
KLLSKTPEL

SEQ ID NO: 3232 - protein, 9 aa, Homo sapiens
KLMGQIHQL

SEQ ID NO: 3233 - protein, 9 aa, Homo sapiens
KLNPGIAYV

SEQ ID NO: 3234 - protein, 9 aa, Homo sapiens
KLQARVVEV

SEQ ID NO: 3235 - protein, 9 aa, Homo sapiens
KLQEFLQTL

SEQ ID NO: 3236 - protein, 9 aa, Homo sapiens
KLQELEARV

SEQ ID NO: 3237 - protein, 9 aa, Homo sapiens
KLSEIPLTL

SEQ ID NO: 3238 - protein, 9 aa, Homo sapiens
KLVEYIVKA

SEQ ID NO: 3239 - protein, 9 aa, Homo sapiens
KLYHNEVEI

SEQ ID NO: 3240 - protein, 9 aa, Homo sapiens
KLYQTPLEL

SEQ ID NO: 3241 - protein, 9 aa, Homo sapiens
KLYSISSQV

SEQ ID NO: 3242 - protein, 9 aa, Homo sapiens
KLYTTAHHL

SEQ ID NO: 3243 - protein, 9 aa, Homo sapiens
KMADIEYRL

SEQ ID NO: 3244 - protein, 9 aa, Homo sapiens
KMLERIPEA

SEQ ID NO: 3245 - protein, 12 aa, Homo sapiens
KMVGDVTGAQAY

SEQ ID NO: 3246 - protein, 11 aa, Homo sapiens
KMWDPHNDPNA

SEQ ID NO: 3247 - protein, 9 aa, Homo sapiens
KQHGVNVSV

SEQ ID NO: 3248 - protein, 9 aa, Homo sapiens
KQISQAYEV

SEQ ID NO: 3249 - protein, 10 aa, Homo sapiens
KQMEQISQFL

SEQ ID NO: 3250 - protein, 9 aa, Homo sapiens
KQYGNEVFL

SEQ ID NO: 3251 - protein, 9 aa, Homo sapiens
KTWGGVVTA

SEQ ID NO: 3252 - protein, 9 aa, Homo sapiens
KVAPAPAVV

SEQ ID NO: 3253 - protein, 9 aa, Homo sapiens
KVFGNEIKL

SEQ ID NO: 3254 - protein, 9 aa, Homo sapiens
KVIDEIYRV

SEQ ID NO: 3255 - protein, 9 aa, Homo sapiens
KVIDGLETL

SEQ ID NO: 3256 - protein, 11 aa, Homo sapiens
KVKVNKDDIQK

SEQ ID NO: 3257 - protein, 9 aa, Homo sapiens
KVLGALLFV

SEQ ID NO: 3258 - protein, 10 aa, Homo sapiens
KVMDLSIVRL

SEQ ID NO: 3259 - protein, 9 aa, Homo sapiens
KVTHAVVTV

SEQ ID NO: 3260 - protein, 9 aa, Homo sapiens
KVVALVHAV

SEQ ID NO: 3261 - protein, 9 aa, Homo sapiens
LDTNADKQL

SEQ ID NO: 3262 - protein, 10 aa, Homo sapiens
LIMGFLVLGL

SEQ ID NO: 3263 - protein, 10 aa, Homo sapiens
LIRKLPFQRL

SEQ ID NO: 3264 - protein, 11 aa, Homo sapiens
LLADIGGDPFA

SEQ ID NO: 3265 - protein, 9 aa, Homo sapiens
LLANKVPAA

SEQ ID NO: 3266 - protein, 9 aa, Homo sapiens
LLAPVVKEI

SEQ ID NO: 3267 - protein, 9 aa, Homo sapiens
LLDPSVFHV

SEQ ID NO: 3268 - protein, 9 aa, Homo sapiens
LLEPFVHQV

SEQ ID NO: 3269 - protein, 9 aa, Homo sapiens
LLFDQAYQM

SEQ ID NO: 3270 - protein, 9 aa, Homo sapiens
LLFPESIRV

SEQ ID NO: 3271 - protein, 9 aa, Homo sapiens
LLFSAFSRA

SEQ ID NO: 3272 - protein, 11 aa, Homo sapiens
LLKEVDNLYNI

SEQ ID NO: 3273 - protein, 9 aa, Homo sapiens
LLLAAPAQA

SEQ ID NO: 3274 - protein, 9 aa, Homo sapiens
LLLAQLSDA

SEQ ID NO: 3275 - protein, 9 aa, Homo sapiens
LLLDMQNRL

SEQ ID NO: 3276 - protein, 9 aa, Homo sapiens
LLNDNIFHM

SEQ ID NO: 3277 - protein, 9 aa, Homo sapiens
LLWVPGCFA

SEQ ID NO: 3278 - protein, 10 aa, Homo sapiens
LLYDDKGVGL

SEQ ID NO: 3279 - protein, 9 aa, Homo sapiens
LLYGSIPKA

SEQ ID NO: 3280 - protein, 11 aa, Homo sapiens
LLYQEGAKMAV

SEQ ID NO: 3281 - protein, 9 aa, Homo sapiens
LMISRTPEV

SEQ ID NO: 3282 - protein, 10 aa, Homo sapiens
LMLDVEEDRL

SEQ ID NO: 3283 - protein, 9 aa, Homo sapiens
LQFDGIHVV

SEQ ID NO: 3284 - protein, 12 aa, Homo sapiens
LTEAPLNPKANR

SEQ ID NO: 3285 - protein, 9 aa, Homo sapiens
MLLDVMHTV

SEQ ID NO: 3286 - protein, 11 aa, Homo sapiens
MLLGNPGLVFS

SEQ ID NO: 3287 - protein, 9 aa, Homo sapiens
MLPPPPLTA

SEQ ID NO: 3288 - protein, 12 aa, Homo sapiens
MLTELEKALNSI

SEQ ID NO: 3289 - protein, 11 aa, Homo sapiens
MQWGQLLDHDL

SEQ ID NO: 3290 - protein, 10 aa, Homo sapiens
MTFLRHRLFL

SEQ ID NO: 3291 - protein, 8 aa, Homo sapiens
MVFKLAQA

SEQ ID NO: 3292 - protein, 9 aa, Homo sapiens
NIIEKLQDV

SEQ ID NO: 3293 - protein, 11 aa, Homo sapiens
NLFGGEPLSYT

SEQ ID NO: 3294 - protein, 9 aa, Homo sapiens
NLQVTQPTV

SEQ ID NO: 3295 - protein, 9 aa, Homo sapiens
NMLEAVHTI

SEQ ID NO: 3296 - protein, 12 aa, Homo sapiens
NSIIDVYHKYSL

SEQ ID NO: 3297 - protein, 9 aa, Homo sapiens
PEVAECFDE

SEQ ID NO: 3298 - protein, 9 aa, Homo sapiens
QLIEKITQV

SEQ ID NO: 3299 - protein, 9 aa, Homo sapiens
RISDVHFSV

SEQ ID NO: 3300 - protein, 9 aa, Homo sapiens
RLASTLVHL

SEQ ID NO: 3301 - protein, 9 aa, Homo sapiens
RLFESSQYL

SEQ ID NO: 3302 - protein, 9 aa, Homo sapiens
RLIQESPTL

SEQ ID NO: 3303 - protein, 9 aa, Homo sapiens
RLQDELVTL

SEQ ID NO: 3304 - protein, 9 aa, Homo sapiens
RLQEFIDEV

SEQ ID NO: 3305 - protein, 9 aa, Homo sapiens
RLQEKVESA

SEQ ID NO: 3306 - protein, 9 aa, Homo sapiens
RLQEVTHSV

SEQ ID NO: 3307 - protein, 9 aa, Homo sapiens
RLSSVNAEV

SEQ ID NO: 3308 - protein, 9 aa, Homo sapiens
RLTQTVAHL

SEQ ID NO: 3309 - protein, 9 aa, Homo sapiens
RLYDKFAEA

SEQ ID NO: 3310 - protein, 10 aa, Homo sapiens
RLYGPSSVSF

SEQ ID NO: 3311 - protein, 9 aa, Homo sapiens
RLYQGINQL

SEQ ID NO: 3312 - protein, 9 aa, Homo sapiens
RMIDIQTRM

SEQ ID NO: 3313 - protein, 9 aa, Homo sapiens
RMWEDPMGA

SEQ ID NO: 3314 - protein, 12 aa, Homo sapiens
RVAPEEHPVLLT

SEQ ID NO: 3315 - protein, 9 aa, Homo sapiens
RVDKNAPTV

SEQ ID NO: 3316 - protein, 9 aa, Homo sapiens
RVFENIVAV

SEQ ID NO: 3317 - protein, 9 aa, Homo sapiens
RVIGTLEEV

SEQ ID NO: 3318 - protein, 9 aa, Homo sapiens
SIAAVLPKV

SEQ ID NO: 3319 - protein, 9 aa, Homo sapiens
SLAQYLINV

SEQ ID NO: 3320 - protein, 9 aa, Homo sapiens
SLASHIQSL

SEQ ID NO: 3321 - protein, 12 aa, Homo sapiens
SLASPSRAASQL

SEQ ID NO: 3322 - protein, 9 aa, Homo sapiens
SLDAKEIYL

SEQ ID NO: 3323 - protein, 9 aa, Homo sapiens
SLDQPTQTV

SEQ ID NO: 3324 - protein, 9 aa, Homo sapiens
SLIEQTTAL

SEQ ID NO: 3325 - protein, 9 aa, Homo sapiens
SLIKQIPRI

SEQ ID NO: 3326 - protein, 9 aa, Homo sapiens
SLLDDLHSA

SEQ ID NO: 3327 - protein, 11 aa, Homo sapiens
SLLESNKDLLL

SEQ ID NO: 3328 - protein, 10 aa, Homo sapiens
SLLPEGPPAI

SEQ ID NO: 3329 - protein, 9 aa, Homo sapiens
SLLPTSPRL

SEQ ID NO: 3330 - protein, 10 aa, Homo sapiens
SLLQDGEFSM

SEQ ID NO: 3331 - protein, 9 aa, Homo sapiens
SLLSELQHA

SEQ ID NO: 3332 - protein, 9 aa, Homo sapiens
SLLSQQPFL

SEQ ID NO: 3333 - protein, 10 aa, Homo sapiens
SLMQAPLLIA

SEQ ID NO: 3334 - protein, 9 aa, Homo sapiens
SLNHFTHSV

SEQ ID NO: 3335 - protein, 9 aa, Homo sapiens
SLSPIYPAA

SEQ ID NO: 3336 - protein, 9 aa, Homo sapiens
SLTGRLDEV

SEQ ID NO: 3337 - protein, 9 aa, Homo sapiens
SLVEQLTMV

SEQ ID NO: 3338 - protein, 9 aa, Homo sapiens
SLVSSLYKV

SEQ ID NO: 3339 - protein, 9 aa, Homo sapiens
SLWPSPEQL

SEQ ID NO: 3340 - protein, 10 aa, Homo sapiens
SLYEGIDFYT

SEQ ID NO: 3341 - protein, 12 aa, Homo sapiens
SMFDQSQIQEFK

SEQ ID NO: 3342 - protein, 9 aa, Homo sapiens
SMMQTLLTV

SEQ ID NO: 3343 - protein, 9 aa, Homo sapiens
SQTFVNPHV

SEQ ID NO: 3344 - protein, 9 aa, Homo sapiens
SQWDSPMRV

SEQ ID NO: 3345 - protein, 9 aa, Homo sapiens
TADEVHYFL

SEQ ID NO: 3346 - protein, 9 aa, Homo sapiens
TLAETLVNL

SEQ ID NO: 3347 - protein, 9 aa, Homo sapiens
TLASIIKEV

SEQ ID NO: 3348 - protein, 9 aa, Homo sapiens
TLASSLHTL

SEQ ID NO: 3349 - protein, 9 aa, Homo sapiens
TLFPSKIGV

SEQ ID NO: 3350 - protein, 9 aa, Homo sapiens
TLGSTVFRV

SEQ ID NO: 3351 - protein, 9 aa, Homo sapiens
TLISRLPAV

SEQ ID NO: 3352 - protein, 9 aa, Homo sapiens
TLMAEMHVV

SEQ ID NO: 3353 - protein, 9 aa, Homo sapiens
TLMDILPRI

SEQ ID NO: 3354 - protein, 9 aa, Homo sapiens
TLMEALHYM

SEQ ID NO: 3355 - protein, 9 aa, Homo sapiens
TLPEVAECF

SEQ ID NO: 3356 - protein, 9 aa, Homo sapiens
TLQEQIEAI

SEQ ID NO: 3357 - protein, 9 aa, Homo sapiens
TLVDEVFRI

SEQ ID NO: 3358 - protein, 9 aa, Homo sapiens
TLVDFDNHL

SEQ ID NO: 3359 - protein, 9 aa, Homo sapiens
TLWPEVQKL

SEQ ID NO: 3360 - protein, 9 aa, Homo sapiens
TLYDHVDEV

SEQ ID NO: 3361 - protein, 9 aa, Homo sapiens
TLYRIFNNK

SEQ ID NO: 3362 - protein, 9 aa, Homo sapiens
TVAEKVDAV

SEQ ID NO: 3363 - protein, 9 aa, Homo sapiens
TVFEHTFHV

SEQ ID NO: 3364 - protein, 9 aa, Homo sapiens
TVLEKVYEL

SEQ ID NO: 3365 - protein, 11 aa, Homo sapiens
VELDDLGKDEL

SEQ ID NO: 3366 - protein, 9 aa, Homo sapiens
VIAEILRGV

SEQ ID NO: 3367 - protein, 9 aa, Homo sapiens
VIDGHIYAV

SEQ ID NO: 3368 - protein, 9 aa, Homo sapiens
VIDQKVYEI

SEQ ID NO: 3369 - protein, 9 aa, Homo sapiens
VIYPARISL

SEQ ID NO: 3370 - protein, 10 aa, Homo sapiens
VKVNKDDIQK

SEQ ID NO: 3371 - protein, 9 aa, Homo sapiens
VLAEKLAAI

SEQ ID NO: 3372 - protein, 9 aa, Homo sapiens
VLDDSTAKL

SEQ ID NO: 3373 - protein, 11 aa, Homo sapiens
VLEGKELEFYL

SEQ ID NO: 3374 - protein, 9 aa, Homo sapiens
VLHEGTNFV

SEQ ID NO: 3375 - protein, 10 aa, Homo sapiens
VLLAAGPSAA

SEQ ID NO: 3376 - protein, 9 aa, Homo sapiens
VLLDHLSLA

SEQ ID NO: 3377 - protein, 11 aa, Homo sapiens
VLLEQEKTFFT

SEQ ID NO: 3378 - protein, 10 aa, Homo sapiens
VLLEQPTWQL

SEQ ID NO: 3379 - protein, 9 aa, Homo sapiens
VLLFIEHSV

SEQ ID NO: 3380 - protein, 9 aa, Homo sapiens
VLTEHVAAA

SEQ ID NO: 3381 - protein, 11 aa, Homo sapiens
VLVEPDAGAGV

SEQ ID NO: 3382 - protein, 10 aa, Homo sapiens
VLYPASPHGV

SEQ ID NO: 3383 - protein, 9 aa, Homo sapiens
VLYSIAEKV

SEQ ID NO: 3384 - protein, 9 aa, Homo sapiens
VMLQINPKL

SEQ ID NO: 3385 - protein, 9 aa, Homo sapiens
VMQDIVYKL

SEQ ID NO: 3386 - protein, 11 aa, Homo sapiens
VMQDPEFLQSV

SEQ ID NO: 3387 - protein, 11 aa, Homo sapiens
VNLPINGNGKQ

SEQ ID NO: 3388 - protein, 9 aa, Homo sapiens
VVDAGKVTL

SEQ ID NO: 3389 - protein, 9 aa, Homo sapiens
VVLSYVKEI

SEQ ID NO: 3390 - protein, 9 aa, Homo sapiens
VVMNVVHQL

SEQ ID NO: 3391 - protein, 9 aa, Homo sapiens
VVNDRSWKV

SEQ ID NO: 3392 - protein, 9 aa, Homo sapiens
VVVEYLRAV

SEQ ID NO: 3393 - protein, 9 aa, Homo sapiens
WLTKVSQPA

SEQ ID NO: 3394 - protein, 10 aa, Homo sapiens
YALPHAILRL

SEQ ID NO: 3395 - protein, 10 aa, Homo sapiens
YAYDGKDYLA

SEQ ID NO: 3396 - protein, 11 aa, Homo sapiens
YAYDGKDYLAL

SEQ ID NO: 3397 - protein, 11 aa, Homo sapiens
YGAEALERMFL

SEQ ID NO: 3398 - protein, 11 aa, Homo sapiens
YIFPLDDKAAV

SEQ ID NO: 3399 - protein, 11 aa, Homo sapiens
YLLEQTPEQQA

SEQ ID NO: 3400 - protein, 9 aa, Homo sapiens
YLLTHLPAV

SEQ ID NO: 3401 - protein, 9 aa, Homo sapiens
YLQDYTDRV

SEQ ID NO: 3402 - protein, 9 aa, Homo sapiens
YLQEIQTQL

SEQ ID NO: 3403 - protein, 9 aa, Homo sapiens
YLRPPNTSL

SEQ ID NO: 3404 - protein, 11 aa, Homo sapiens
YLYESGETEKL

SEQ ID NO: 3405 - protein, 8 aa, Homo sapiens
YQSKYEEL

SEQ ID NO: 3406 - protein, 8 aa, Homo sapiens
YQTKYEEL

SEQ ID NO: 3407 - protein, 9 aa, Homo sapiens
YSDDIPHAL

SEQ ID NO: 3408 - protein, 10 aa, Homo sapiens
YVFENTVATV

SEQ ID NO: 3409 - protein, 9 aa, Homo sapiens
AAAPVVPAV

SEQ ID NO: 3410 - protein, 9 aa, Homo sapiens
AALPNVYEV

SEQ ID NO: 3411 - protein, 9 aa, Homo sapiens
AIAPIIAAV

SEQ ID NO: 3412 - protein, 10 aa, Homo sapiens
AIDPHLLLSV

SEQ ID NO: 3413 - protein, 9 aa, Homo sapiens
AIIESTPEL

SEQ ID NO: 3414 - protein, 9 aa, Homo sapiens
AIIEYMPLL

SEQ ID NO: 3415 - protein, 9 aa, Homo sapiens
AIISELVSI

SEQ ID NO: 3416 - protein, 9 aa, Homo sapiens
AILGPTFTL

SEQ ID NO: 3417 - protein, 9 aa, Homo sapiens
AILTTLIHL

SEQ ID NO: 3418 - protein, 9 aa, Homo sapiens
AINPKLLQL

SEQ ID NO: 3419 - protein, 9 aa, Homo sapiens
ALAEALKEV

SEQ ID NO: 3420 - protein, 10 aa, Homo sapiens
ALALIYNEAL

SEQ ID NO: 3421 - protein, 9 aa, Homo sapiens
ALANQIPTV

SEQ ID NO: 3422 - protein, 11 aa, Homo sapiens
ALAPSTMKIKI

SEQ ID NO: 3423 - protein, 9 aa, Homo sapiens
ALASHLIEA

SEQ ID NO: 3424 - protein, 9 aa, Homo sapiens
ALASLIRSV

SEQ ID NO: 3425 - protein, 9 aa, Homo sapiens
ALASVIMGL

SEQ ID NO: 3426 - protein, 9 aa, Homo sapiens
ALDEKLLNI

SEQ ID NO: 3427 - protein, 10 aa, Homo sapiens
ALDESHNQNL

SEQ ID NO: 3428 - protein, 12 aa, Homo sapiens
ALDFEQEMATAA

SEQ ID NO: 3429 - protein, 10 aa, Homo sapiens
ALDPAAQAFL

SEQ ID NO: 3430 - protein, 11 aa, Homo sapiens
ALDPLADKILI

SEQ ID NO: 3431 - protein, 9 aa, Homo sapiens
ALDPNIATL

SEQ ID NO: 3432 - protein, 9 aa, Homo sapiens
ALDSTNVEA

SEQ ID NO: 3433 - protein, 9 aa, Homo sapiens
ALDTINILL

SEQ ID NO: 3434 - protein, 9 aa, Homo sapiens
ALDTNQVLL

SEQ ID NO: 3435 - protein, 11 aa, Homo sapiens
ALFARPDLLLL

SEQ ID NO: 3436 - protein, 9 aa, Homo sapiens
ALFEEVPEL

SEQ ID NO: 3437 - protein, 11 aa, Homo sapiens
ALFEQKGPVYV

SEQ ID NO: 3438 - protein, 9 aa, Homo sapiens
ALFGTILEL

SEQ ID NO: 3439 - protein, 10 aa, Homo sapiens
ALFPAPLAQI

SEQ ID NO: 3440 - protein, 9 aa, Homo sapiens
ALFPGVALL

SEQ ID NO: 3441 - protein, 11 aa, Homo sapiens
ALFPHLLQPVL

SEQ ID NO: 3442 - protein, 9 aa, Homo sapiens
ALFPLLPKV

SEQ ID NO: 3443 - protein, 10 aa, Homo sapiens
ALFTKVLENV

SEQ ID NO: 3444 - protein, 9 aa, Homo sapiens
ALHDQLFYL

SEQ ID NO: 3445 - protein, 9 aa, Homo sapiens
ALHSVEVEL

SEQ ID NO: 3446 - protein, 10 aa, Homo sapiens
ALIEGAGILL

SEQ ID NO: 3447 - protein, 10 aa, Homo sapiens
ALIEGVGILL

SEQ ID NO: 3448 - protein, 10 aa, Homo sapiens
ALIPIPLAVI

SEQ ID NO: 3449 - protein, 9 aa, Toxoplasma gondii
ALLALLIYA

SEQ ID NO: 3450 - protein, 9 aa, Homo sapiens
ALLDIIRSL

SEQ ID NO: 3451 - protein, 8 aa, Homo sapiens
ALLDKLYA

SEQ ID NO: 3452 - protein, 9 aa, Homo sapiens
ALLDKMVLL

SEQ ID NO: 3453 - protein, 10 aa, Homo sapiens
ALLDVTPKAV

SEQ ID NO: 3454 - protein, 9 aa, Homo sapiens
ALLDWVTSV

SEQ ID NO: 3455 - protein, 11 aa, Homo sapiens
ALLENMEGLFL

SEQ ID NO: 3456 - protein, 10 aa, Homo sapiens
ALLENPKMEL

SEQ ID NO: 3457 - protein, 9 aa, Homo sapiens
ALLEQVNAL

SEQ ID NO: 3458 - protein, 9 aa, Homo sapiens
ALLETVNRL

SEQ ID NO: 3459 - protein, 9 aa, Homo sapiens
ALLGGLVNV

SEQ ID NO: 3460 - protein, 10 aa, Homo sapiens
ALLKIEGVYA

SEQ ID NO: 3461 - protein, 9 aa, Homo sapiens
ALLNNVIEV

SEQ ID NO: 3462 - protein, 9 aa, Homo sapiens
ALLPDLPAL

SEQ ID NO: 3463 - protein, 9 aa, Homo sapiens
ALLPIFFGA

SEQ ID NO: 3464 - protein, 9 aa, Homo sapiens
ALLPSSPTL

SEQ ID NO: 3465 - protein, 9 aa, Homo sapiens
ALLPYFVYV

SEQ ID NO: 3466 - protein, 9 aa, Homo sapiens
ALLQSDVRL

SEQ ID NO: 3467 - protein, 9 aa, Homo sapiens
ALLSRLEQI

SEQ ID NO: 3468 - protein, 9 aa, Homo sapiens
ALLTVVSQV

SEQ ID NO: 3469 - protein, 9 aa, Homo sapiens
ALMADMVYV

SEQ ID NO: 3470 - protein, 9 aa, Homo sapiens
ALMPTLEAL

SEQ ID NO: 3471 - protein, 9 aa, Homo sapiens
ALNGHVEMV

SEQ ID NO: 3472 - protein, 9 aa, Homo sapiens
ALNSKILSV

SEQ ID NO: 3473 - protein, 9 aa, Homo sapiens
ALPDSMVSV

SEQ ID NO: 3474 - protein, 9 aa, Homo sapiens
ALPEIFTEL

SEQ ID NO: 3475 - protein, 9 aa, Homo sapiens
ALPPVLTTV

SEQ ID NO: 3476 - protein, 9 aa, Homo sapiens
ALPTLIPSV

SEQ ID NO: 3477 - protein, 9 aa, Homo sapiens
ALQSLLHLL

SEQ ID NO: 3478 - protein, 9 aa, Homo sapiens
ALSDLEITL

SEQ ID NO: 3479 - protein, 9 aa, Homo sapiens
ALSEQILMV

SEQ ID NO: 3480 - protein, 9 aa, Homo sapiens
ALSNLEVTL

SEQ ID NO: 3481 - protein, 9 aa, Homo sapiens
ALSPHNILL

SEQ ID NO: 3482 - protein, 9 aa, Homo sapiens
ALSQDIPEI

SEQ ID NO: 3483 - protein, 9 aa, Homo sapiens
ALSQINTKL

SEQ ID NO: 3484 - protein, 9 aa, Homo sapiens
ALSSVIKEL

SEQ ID NO: 3485 - protein, 9 aa, Homo sapiens
ALTELLAKI

SEQ ID NO: 3486 - protein, 9 aa, Homo sapiens
ALTEYTLYL

SEQ ID NO: 3487 - protein, 9 aa, Artificial Sequence
  unknown
ALTNAVAHV

SEQ ID NO: 3488 - protein, 9 aa, Homo sapiens
ALTPVVVTL

SEQ ID NO: 3489 - protein, 9 aa, Homo sapiens
ALTSVVVTL

SEQ ID NO: 3490 - protein, 9 aa, Homo sapiens
ALVDILSEV

SEQ ID NO: 3491 - protein, 9 aa, Homo sapiens
ALVDQLWKL

SEQ ID NO: 3492 - protein, 9 aa, Homo sapiens
ALVEKLESL

SEQ ID NO: 3493 - protein, 9 aa, Homo sapiens
ALVESLEYV

SEQ ID NO: 3494 - protein, 9 aa, Homo sapiens
ALVQDLAKA

SEQ ID NO: 3495 - protein, 9 aa, Homo sapiens
ALVVQVAEA

SEQ ID NO: 3496 - protein, 9 aa, Homo sapiens
ALWAGLLTL

SEQ ID NO: 3497 - protein, 8 aa, Homo sapiens
ALWDKLFN

SEQ ID NO: 3498 - protein, 9 aa, Homo sapiens
ALWDKLFNL

SEQ ID NO: 3499 - protein, 8 aa, Homo sapiens
ALWGFFPV

SEQ ID NO: 3500 - protein, 9 aa, Homo sapiens
ALWNEEALL

SEQ ID NO: 3501 - protein, 9 aa, Homo sapiens
ALYGQPLLL

SEQ ID NO: 3502 - protein, 9 aa, Homo sapiens
ALYPNVVQV

SEQ ID NO: 3503 - protein, 9 aa, Homo sapiens
ALYSKGILL

SEQ ID NO: 3504 - protein, 9 aa, Homo sapiens
AMAASPHAV

SEQ ID NO: 3505 - protein, 9 aa, Homo sapiens
AMAPGTVTV

SEQ ID NO: 3506 - protein, 9 aa, Homo sapiens
AMFDKKVQL

SEQ ID NO: 3507 - protein, 9 aa, Homo sapiens
AMLPSITNV

SEQ ID NO: 3508 - protein, 9 aa, Homo sapiens
AMNARPHKV

SEQ ID NO: 3509 - protein, 9 aa, Homo sapiens
AMNGHTAAV

SEQ ID NO: 3510 - protein, 10 aa, Homo sapiens
AMPALAPPEV

SEQ ID NO: 3511 - protein, 9 aa, Homo sapiens
AMPDSPAEV

SEQ ID NO: 3512 - protein, 10 aa, Homo sapiens
AMPPPPPQGV

SEQ ID NO: 3513 - protein, 11 aa, Homo sapiens
AMVPGHHIVSI

SEQ ID NO: 3514 - protein, 12 aa, Homo sapiens
AQGGVLPNIQAV

SEQ ID NO: 3515 - protein, 10 aa, Homo sapiens
AQYEHDLEVA

SEQ ID NO: 3516 - protein, 9 aa, Homo sapiens
ASVDKVLEL

SEQ ID NO: 3517 - protein, 9 aa, Homo sapiens
ATIGELAQV

SEQ ID NO: 3518 - protein, 9 aa, Homo sapiens
ATMPVVPSV

SEQ ID NO: 3519 - protein, 11 aa, Homo sapiens
AVAASKERSGV

SEQ ID NO: 3520 - protein, 9 aa, Homo sapiens
AVANIVNSV

SEQ ID NO: 3521 - protein, 8 aa, Homo sapiens
AVGPYIQV

SEQ ID NO: 3522 - protein, 11 aa, Homo sapiens
AVLGPLGLQEV

SEQ ID NO: 3523 - protein, 11 aa, Homo sapiens
AVLSKEYGFVL

SEQ ID NO: 3524 - protein, 9 aa, Homo sapiens
AVMEQIPEI

SEQ ID NO: 3525 - protein, 9 aa, Homo sapiens
AVTGILVQL

SEQ ID NO: 3526 - protein, 9 aa, Homo sapiens
DMYEQFQNI

SEQ ID NO: 3527 - protein, 11 aa, Homo sapiens
FAIDPHLLLSV

SEQ ID NO: 3528 - protein, 9 aa, Homo sapiens
FAIPMIHAV

SEQ ID NO: 3529 - protein, 9 aa, Homo sapiens
FAMPYFIQV

SEQ ID NO: 3530 - protein, 10 aa, Homo sapiens
FGSAFATPFL

SEQ ID NO: 3531 - protein, 10 aa, Homo sapiens
FIFPASNVYL

SEQ ID NO: 3532 - protein, 9 aa, Homo sapiens
FIIANIPLP

SEQ ID NO: 3533 - protein, 9 aa, Homo sapiens
FIISDFESV

SEQ ID NO: 3534 - protein, 9 aa, Homo sapiens
FILPFIIAA

SEQ ID NO: 3535 - protein, 8 aa, Homo sapiens
FILPFVSV

SEQ ID NO: 3536 - protein, 9 aa, Homo sapiens
FILPSSLYL

SEQ ID NO: 3537 - protein, 8 aa, Homo sapiens
FIPVALFV

SEQ ID NO: 3538 - protein, 11 aa, Homo sapiens
FIWKSGGDLTL

SEQ ID NO: 3539 - protein, 9 aa, Homo sapiens
FIWPMLIHI

SEQ ID NO: 3540 - protein, 11 aa, Homo sapiens
FIYPSNMQTML

SEQ ID NO: 3541 - protein, 9 aa, Homo sapiens
FIYTGTLNL

SEQ ID NO: 3542 - protein, 9 aa, Homo sapiens
FLADAKWIL

SEQ ID NO: 3543 - protein, 9 aa, Toxoplasma gondii
FLADLLHSV

SEQ ID NO: 3544 - protein, 10 aa, Homo sapiens
FLADPSAFVA

SEQ ID NO: 3545 - protein, 11 aa, Homo sapiens
FLAELPGSLSL

SEQ ID NO: 3546 - protein, 11 aa, Homo sapiens
FLAPARAILSL

SEQ ID NO: 3547 - protein, 8 aa, Homo sapiens
FLDGNELT

SEQ ID NO: 3548 - protein, 9 aa, Homo sapiens
FLDHVMYTI

SEQ ID NO: 3549 - protein, 9 aa, Homo sapiens
FLDLGPPGI

SEQ ID NO: 3550 - protein, 9 aa, Homo sapiens
FLDNLHINL

SEQ ID NO: 3551 - protein, 9 aa, Toxoplasma gondii
FLDRALLTL

SEQ ID NO: 3552 - protein, 9 aa, Homo sapiens
FLDSTSPLL

SEQ ID NO: 3553 - protein, 9 aa, Homo sapiens
FLDTLKVLV

SEQ ID NO: 3554 - protein, 8 aa, Homo sapiens
FLFDHLLT

SEQ ID NO: 3555 - protein, 9 aa, Homo sapiens
FLFDHLLTL

SEQ ID NO: 3556 - protein, 9 aa, Homo sapiens
FLFDKVVIV

SEQ ID NO: 3557 - protein, 10 aa, Homo sapiens
FLFDNDFPAL

SEQ ID NO: 3558 - protein, 9 aa, Homo sapiens
FLFDTQHFI

SEQ ID NO: 3559 - protein, 9 aa, Homo sapiens
FLFPVYPLI

SEQ ID NO: 3560 - protein, 11 aa, Homo sapiens
FLGASLKDEVL

SEQ ID NO: 3561 - protein, 10 aa, Homo sapiens
FLGENISNFL

SEQ ID NO: 3562 - protein, 10 aa, Homo sapiens
FLHDHVDLQV

SEQ ID NO: 3563 - protein, 9 aa, Homo sapiens
FLHEVLWEL

SEQ ID NO: 3564 - protein, 9 aa, Homo sapiens
FLIAQLPKL

SEQ ID NO: 3565 - protein, 10 aa, Homo sapiens
FLIETGPRGV

SEQ ID NO: 3566 - protein, 9 aa, Homo sapiens
FLIKVNTEN

SEQ ID NO: 3567 - protein, 9 aa, Homo sapiens
FLINFIHTL

SEQ ID NO: 3568 - protein, 9 aa, Homo sapiens
FLINTNSEL

SEQ ID NO: 3569 - protein, 9 aa, Homo sapiens
FLIPAVELI

SEQ ID NO: 3570 - protein, 9 aa, Homo sapiens
FLIPFVITV

SEQ ID NO: 3571 - protein, 10 aa, Homo sapiens
FLIQQKLVEA

SEQ ID NO: 3572 - protein, 9 aa, Homo sapiens
FLIRNIPVI

SEQ ID NO: 3573 - protein, 9 aa, Homo sapiens
FLITQLKML

SEQ ID NO: 3574 - protein, 9 aa, Homo sapiens
FLKEYLHFV

SEQ ID NO: 3575 - protein, 9 aa, Homo sapiens
FLKNELDNV

SEQ ID NO: 3576 - protein, 9 aa, Homo sapiens
FLLALEPEL

SEQ ID NO: 3577 - protein, 10 aa, Homo sapiens
FLLDGKVLSL

SEQ ID NO: 3578 - protein, 9 aa, Homo sapiens
FLLDKALLI

SEQ ID NO: 3579 - protein, 11 aa, Homo sapiens
FLLDPYKYMTL

SEQ ID NO: 3580 - protein, 10 aa, Homo sapiens
FLLDSAPLNV

SEQ ID NO: 3581 - protein, 10 aa, Homo sapiens
FLLEPGNLEV

SEQ ID NO: 3582 - protein, 10 aa, Homo sapiens
FLLGPRLVLA

SEQ ID NO: 3583 - protein, 9 aa, Homo sapiens
FLLPAGWIL

SEQ ID NO: 3584 - protein, 9 aa, Homo sapiens
FLLPDVIRI

SEQ ID NO: 3585 - protein, 10 aa, Homo sapiens
FLLPHPGLQV

SEQ ID NO: 3586 - protein, 11 aa, Homo sapiens
FLLPKVQSIQL

SEQ ID NO: 3587 - protein, 9 aa, Homo sapiens
FLLPLRIAL

SEQ ID NO: 3588 - protein, 9 aa, Homo sapiens
FLLPPVFNI

SEQ ID NO: 3589 - protein, 10 aa, Homo sapiens
FLLPSEVPAL

SEQ ID NO: 3590 - protein, 9 aa, Homo sapiens
FLLPTGVYL

SEQ ID NO: 3591 - protein, 9 aa, Homo sapiens
FLLPVAVKL

SEQ ID NO: 3592 - protein, 9 aa, Homo sapiens
FLLPVINEM

SEQ ID NO: 3593 - protein, 9 aa, Homo sapiens
FLMPATVFM

SEQ ID NO: 3594 - protein, 9 aa, Homo sapiens
FLMPGLAAL

SEQ ID NO: 3595 - protein, 10 aa, Homo sapiens
FLMQYPGRSL

SEQ ID NO: 3596 - protein, 9 aa, Homo sapiens
FLNDEVWNL

SEQ ID NO: 3597 - protein, 8 aa, Homo sapiens
FLNGLEIL

SEQ ID NO: 3598 - protein, 9 aa, Homo sapiens
FLNGLEILL

SEQ ID NO: 3599 - protein, 9 aa, Homo sapiens
FLNNQEYVL

SEQ ID NO: 3600 - protein, 9 aa, Homo sapiens
FLNQAQIEV

SEQ ID NO: 3601 - protein, 9 aa, Homo sapiens
FLNVTSVHL

SEQ ID NO: 3602 - protein, 9 aa, Homo sapiens
FLPESVAVV

SEQ ID NO: 3603 - protein, 9 aa, Homo sapiens
FLPLIVNTV

SEQ ID NO: 3604 - protein, 9 aa, Homo sapiens
FLPPLPTSV

SEQ ID NO: 3605 - protein, 9 aa, Homo sapiens
FLPPPFPPP

SEQ ID NO: 3606 - protein, 9 aa, Homo sapiens
FLPPSFPIV

SEQ ID NO: 3607 - protein, 9 aa, Homo sapiens
FLPPYTFQI

SEQ ID NO: 3608 - protein, 11 aa, Homo sapiens
FLQDIPDGLFL

SEQ ID NO: 3609 - protein, 10 aa, Homo sapiens
FLQEGDLISA

SEQ ID NO: 3610 - protein, 9 aa, Homo sapiens
FLQEYGLSV

SEQ ID NO: 3611 - protein, 10 aa, Homo sapiens
FLSDGTIISV

SEQ ID NO: 3612 - protein, 9 aa, Homo sapiens
FLSEKLERI

SEQ ID NO: 3613 - protein, 9 aa, Homo sapiens
FLSESVLAV

SEQ ID NO: 3614 - protein, 9 aa, Homo sapiens
FLSPFNMIL

SEQ ID NO: 3615 - protein, 9 aa, Homo sapiens
FLSSVIQNL

SEQ ID NO: 3616 - protein, 9 aa, Homo sapiens
FLSTINVGL

SEQ ID NO: 3617 - protein, 10 aa, Homo sapiens
FLSTLHEVYL

SEQ ID NO: 3618 - protein, 8 aa, Homo sapiens
FLTEIENL

SEQ ID NO: 3619 - protein, 9 aa, Homo sapiens
FLTHVNPRL

SEQ ID NO: 3620 - protein, 8 aa, Homo sapiens
FLVDSQFM

SEQ ID NO: 3621 - protein, 9 aa, Homo sapiens
FLVPVLEAL

SEQ ID NO: 3622 - protein, 10 aa, Homo sapiens
FLWDEGFHQL

SEQ ID NO: 3623 - protein, 11 aa, Homo sapiens
FLWDVPSNWTL

SEQ ID NO: 3624 - protein, 9 aa, Homo sapiens
FLWERPTLL

SEQ ID NO: 3625 - protein, 10 aa, Homo sapiens
FLWERPTLLV

SEQ ID NO: 3626 - protein, 10 aa, Homo sapiens
FLWPGLNVPL

SEQ ID NO: 3627 - protein, 11 aa, Homo sapiens
FLWQEGHSAFA

SEQ ID NO: 3628 - protein, 9 aa, Homo sapiens
FLYPFLHTV

SEQ ID NO: 3629 - protein, 8 aa, Homo sapiens
FLYPFPLA

SEQ ID NO: 3630 - protein, 9 aa, Homo sapiens
FLYQYSTRL

SEQ ID NO: 3631 - protein, 9 aa, Homo sapiens
FLYSDEVQI

SEQ ID NO: 3632 - protein, 10 aa, Homo sapiens
FLYSGEPTYL

SEQ ID NO: 3633 - protein, 9 aa, Homo sapiens
FMAPKAWTV

SEQ ID NO: 3634 - protein, 11 aa, Homo sapiens
FMAQALQEYNN

SEQ ID NO: 3635 - protein, 9 aa, Homo sapiens
FMLPDPQNI

SEQ ID NO: 3636 - protein, 11 aa, Homo sapiens
FMLPDPQNISL

SEQ ID NO: 3637 - protein, 9 aa, Homo sapiens
FMNPHLISV

SEQ ID NO: 3638 - protein, 10 aa, Homo sapiens
FMQDPMEIFV

SEQ ID NO: 3639 - protein, 9 aa, Homo sapiens
FMVDKAIYL

SEQ ID NO: 3640 - protein, 9 aa, Homo sapiens
FMYPVVLQV

SEQ ID NO: 3641 - protein, 9 aa, Homo sapiens
FQAEIAQLM

SEQ ID NO: 3642 - protein, 9 aa, Homo sapiens
FQDPVPLTV

SEQ ID NO: 3643 - protein, 9 aa, Homo sapiens
FQIGPVAGV

SEQ ID NO: 3644 - protein, 9 aa, Homo sapiens
FQTDLIYNL

SEQ ID NO: 3645 - protein, 9 aa, Homo sapiens
FQVPWLESV

SEQ ID NO: 3646 - protein, 9 aa, Homo sapiens
FVFPGELLL

SEQ ID NO: 3647 - protein, 9 aa, Toxoplasma gondii
FVGSYLVIV

SEQ ID NO: 3648 - protein, 9 aa, Homo sapiens
FVHDLVLYL

SEQ ID NO: 3649 - protein, 9 aa, Homo sapiens
FVLDKVPFL

SEQ ID NO: 3650 - protein, 9 aa, Homo sapiens
FVLPVATQI

SEQ ID NO: 3651 - protein, 11 aa, Homo sapiens
FVYDPLVDWTA

SEQ ID NO: 3652 - protein, 12 aa, Homo sapiens
FVYSQVVFSGKA

SEQ ID NO: 3653 - protein, 9 aa, Homo sapiens
GIAELVPGV

SEQ ID NO: 3654 - protein, 10 aa, Homo sapiens
GIHETTFNSI

SEQ ID NO: 3655 - protein, 11 aa, Homo sapiens
GILEGIGILAV

SEQ ID NO: 3656 - protein, 10 aa, Homo sapiens
GILGIQPPSV

SEQ ID NO: 3657 - protein, 9 aa, Homo sapiens
GILPMVPEV

SEQ ID NO: 3658 - protein, 9 aa, Homo sapiens
GIMKKAYEL

SEQ ID NO: 3659 - protein, 10 aa, Homo sapiens
GIYDGILHSI

SEQ ID NO: 3660 - protein, 10 aa, Homo sapiens
GLAAGGIVAV

SEQ ID NO: 3661 - protein, 8 aa, Homo sapiens
GLADKVYF

SEQ ID NO: 3662 - protein, 11 aa, Homo sapiens
GLAEQSVLAAL

SEQ ID NO: 3663 - protein, 9 aa, Homo sapiens
GLAESVSTL

SEQ ID NO: 3664 - protein, 10 aa, Homo sapiens
GLAPFLLNAV

SEQ ID NO: 3665 - protein, 9 aa, Homo sapiens
GLAPKPVQV

SEQ ID NO: 3666 - protein, 9 aa, Homo sapiens
GLAQVITAV

SEQ ID NO: 3667 - protein, 9 aa, Homo sapiens
GLDNINVFL

SEQ ID NO: 3668 - protein, 10 aa, Homo sapiens
GLDPGKQYHV

SEQ ID NO: 3669 - protein, 11 aa, Homo sapiens
GLDPLGYEIQL

SEQ ID NO: 3670 - protein, 12 aa, Homo sapiens
GLESEELEPEEL

SEQ ID NO: 3671 - protein, 9 aa, Homo sapiens
GLFDTAISL

SEQ ID NO: 3672 - protein, 9 aa, Homo sapiens
GLFSAKLFL

SEQ ID NO: 3673 - protein, 9 aa, Homo sapiens
GLHGWAFTL

SEQ ID NO: 3674 - protein, 9 aa, Homo sapiens
GLHNVVYGI

SEQ ID NO: 3675 - protein, 9 aa, Homo sapiens
GLIDEIYGI

SEQ ID NO: 3676 - protein, 9 aa, Homo sapiens
GLIDENPGL

SEQ ID NO: 3677 - protein, 8 aa, Homo sapiens
GLIDFAIQ

SEQ ID NO: 3678 - protein, 9 aa, Homo sapiens
GLIDGVVEA

SEQ ID NO: 3679 - protein, 9 aa, Homo sapiens
GLIDVHVHL

SEQ ID NO: 3680 - protein, 9 aa, Homo sapiens
GLIGQLDEV

SEQ ID NO: 3681 - protein, 10 aa, Homo sapiens
GLINTGVLSV

SEQ ID NO: 3682 - protein, 10 aa, Homo sapiens
GLIRFPLMTI

SEQ ID NO: 3683 - protein, 9 aa, Homo sapiens
GLKELSEYV

SEQ ID NO: 3684 - protein, 9 aa, Homo sapiens
GLLDAVTYL

SEQ ID NO: 3685 - protein, 9 aa, Homo sapiens
GLLDLPFRV

SEQ ID NO: 3686 - protein, 10 aa, Homo sapiens
GLLDNPELRV

SEQ ID NO: 3687 - protein, 11 aa, Homo sapiens
GLLDPGMLVNI

SEQ ID NO: 3688 - protein, 9 aa, Homo sapiens
GLLEGVRGV

SEQ ID NO: 3689 - protein, 9 aa, Homo sapiens
GLLGNVAEV

SEQ ID NO: 3690 - protein, 9 aa, Homo sapiens
GLLGNVVNI

SEQ ID NO: 3691 - protein, 9 aa, Homo sapiens
GLLKVVPQA

SEQ ID NO: 3692 - protein, 9 aa, Homo sapiens
GLLNNIAEV

SEQ ID NO: 3693 - protein, 10 aa, Homo sapiens
GLLNRPNPLL

SEQ ID NO: 3694 - protein, 9 aa, Homo sapiens
GLLPDVPSL

SEQ ID NO: 3695 - protein, 11 aa, Homo sapiens
GLLPEPNILQL

SEQ ID NO: 3696 - protein, 9 aa, Homo sapiens
GLLRIIPYL

SEQ ID NO: 3697 - protein, 10 aa, Homo sapiens
GLMDDVDFKA

SEQ ID NO: 3698 - protein, 9 aa, Homo sapiens
GLMEDLLKL

SEQ ID NO: 3699 - protein, 9 aa, Homo sapiens
GLQQELAAL

SEQ ID NO: 3700 - protein, 9 aa, Homo sapiens
GLSDLRLEL

SEQ ID NO: 3701 - protein, 9 aa, Homo sapiens
GLSETILAV

SEQ ID NO: 3702 - protein, 9 aa, Homo sapiens
GLSQVAVTV

SEQ ID NO: 3703 - protein, 9 aa, Homo sapiens
GLSVIIPHV

SEQ ID NO: 3704 - protein, 9 aa, Homo sapiens
GLTPFVFRL

SEQ ID NO: 3705 - protein, 9 aa, Homo sapiens
GLTSAIQAV

SEQ ID NO: 3706 - protein, 10 aa, Homo sapiens
GLVAGGIIGA

SEQ ID NO: 3707 - protein, 9 aa, Homo sapiens
GLVASLISV

SEQ ID NO: 3708 - protein, 9 aa, Homo sapiens
GLVATLQSL

SEQ ID NO: 3709 - protein, 9 aa, Homo sapiens
GLVDQLVKA

SEQ ID NO: 3710 - protein, 8 aa, Homo sapiens
GLVPFLVS

SEQ ID NO: 3711 - protein, 9 aa, Homo sapiens
GLWEQENHL

SEQ ID NO: 3712 - protein, 10 aa, Homo sapiens
GLWGQSVPTA

SEQ ID NO: 3713 - protein, 9 aa, Homo sapiens
GLWGTVVNI

SEQ ID NO: 3714 - protein, 10 aa, Homo sapiens
GLYDGMEHLI

SEQ ID NO: 3715 - protein, 9 aa, Homo sapiens
GLYEGLDWL

SEQ ID NO: 3716 - protein, 10 aa, Homo sapiens
GLYEGLDWLA

SEQ ID NO: 3717 - protein, 9 aa, Homo sapiens
GLYEGLTWL

SEQ ID NO: 3718 - protein, 9 aa, Homo sapiens
GLYELVWRV

SEQ ID NO: 3719 - protein, 9 aa, Homo sapiens
GLYGAIFRL

SEQ ID NO: 3720 - protein, 9 aa, Homo sapiens
GLYPNLIQV

SEQ ID NO: 3721 - protein, 10 aa, Homo sapiens
GMASLNLPAV

SEQ ID NO: 3722 - protein, 9 aa, Homo sapiens
GMDRYLIYV

SEQ ID NO: 3723 - protein, 9 aa, Homo sapiens
GMLDGLVNV

SEQ ID NO: 3724 - protein, 9 aa, Homo sapiens
GMLEKIDMI

SEQ ID NO: 3725 - protein, 9 aa, Homo sapiens
GMVETRVFL

SEQ ID NO: 3726 - protein, 9 aa, Homo sapiens
GMYPNLVHV

SEQ ID NO: 3727 - protein, 9 aa, Homo sapiens
GMYVFLHAV

SEQ ID NO: 3728 - protein, 10 aa, Homo sapiens
GQFPSYLETV

SEQ ID NO: 3729 - protein, 9 aa, Homo sapiens
GQIEVVPEV

SEQ ID NO: 3730 - protein, 9 aa, Homo sapiens
GQWKKGFVL

SEQ ID NO: 3731 - protein, 11 aa, Homo sapiens
GVYKKLTGKDV

SEQ ID NO: 3732 - protein, 9 aa, Homo sapiens
HIIENIVAV

SEQ ID NO: 3733 - protein, 9 aa, Homo sapiens
HLADFTPRL

SEQ ID NO: 3734 - protein, 9 aa, Homo sapiens
HLAELIAEL

SEQ ID NO: 3735 - protein, 9 aa, Homo sapiens
HLGDFLVFL

SEQ ID NO: 3736 - protein, 9 aa, Homo sapiens
HLIEPLANA

SEQ ID NO: 3737 - protein, 9 aa, Homo sapiens
HLINYIIFL

SEQ ID NO: 3738 - protein, 9 aa, Homo sapiens
HLLEEPIYL

SEQ ID NO: 3739 - protein, 9 aa, Homo sapiens
HLLNESPML

SEQ ID NO: 3740 - protein, 10 aa, Homo sapiens
HLLPTAPTTV

SEQ ID NO: 3741 - protein, 9 aa, Homo sapiens
HLLSDELLL

SEQ ID NO: 3742 - protein, 12 aa, Artificial Sequence
  unknown
HLPAEFTPAVHA

SEQ ID NO: 3743 - protein, 9 aa, Homo sapiens
HLSIINEYL

SEQ ID NO: 3744 - protein, 9 aa, Homo sapiens
HLSNMEVQV

SEQ ID NO: 3745 - protein, 9 aa, Homo sapiens
HLSVVSVTV

SEQ ID NO: 3746 - protein, 10 aa, Homo sapiens
HLTPEEKSAV

SEQ ID NO: 3747 - protein, 9 aa, Homo sapiens
HLWNSIHGL

SEQ ID NO: 3748 - protein, 11 aa, Homo sapiens
HLYSSIEHLTT

SEQ ID NO: 3749 - protein, 9 aa, Homo sapiens
HQILTPFLL

SEQ ID NO: 3750 - protein, 8 aa, Homo sapiens
HVFKVFVA

SEQ ID NO: 3751 - protein, 9 aa, Homo sapiens
IAFPTSISV

SEQ ID NO: 3752 - protein, 12 aa, Homo sapiens
IALNEDLRSWTA

SEQ ID NO: 3753 - protein, 11 aa, Homo sapiens
ICLGHQLLALA

SEQ ID NO: 3754 - protein, 11 aa, Homo sapiens
IIAPPERKYSV

SEQ ID NO: 3755 - protein, 9 aa, Homo sapiens
IIFVPVPQL

SEQ ID NO: 3756 - protein, 9 aa, Homo sapiens
IIIDSVPEV

SEQ ID NO: 3757 - protein, 9 aa, Homo sapiens
IIINHVISV

SEQ ID NO: 3758 - protein, 9 aa, Homo sapiens
IIMETVPQL

SEQ ID NO: 3759 - protein, 9 aa, Homo sapiens
IIMPHNIYL

SEQ ID NO: 3760 - protein, 9 aa, Homo sapiens
IINTHTLLL

SEQ ID NO: 3761 - protein, 8 aa, Homo sapiens
IIPEGTWI

SEQ ID NO: 3762 - protein, 9 aa, Homo sapiens
ILADATEQV

SEQ ID NO: 3763 - protein, 9 aa, Homo sapiens
ILADLLPSL

SEQ ID NO: 3764 - protein, 9 aa, Homo sapiens
ILAPLAWDL

SEQ ID NO: 3765 - protein, 9 aa, Homo sapiens
ILAQIMPFL

SEQ ID NO: 3766 - protein, 9 aa, Homo sapiens
ILAQQPLSV

SEQ ID NO: 3767 - protein, 9 aa, Homo sapiens
ILDDSHLLV

SEQ ID NO: 3768 - protein, 9 aa, Homo sapiens
ILDFQPPEL

SEQ ID NO: 3769 - protein, 9 aa, Homo sapiens
ILEPFLPAV

SEQ ID NO: 3770 - protein, 9 aa, Homo sapiens
ILEPSLYTV

SEQ ID NO: 3771 - protein, 10 aa, Homo sapiens
ILFANPNIFV

SEQ ID NO: 3772 - protein, 9 aa, Homo sapiens
ILGIQPPSV

SEQ ID NO: 3773 - protein, 9 aa, Homo sapiens
ILIGYLEYV

SEQ ID NO: 3774 - protein, 9 aa, Homo sapiens
ILIHDVPLL

SEQ ID NO: 3775 - protein, 9 aa, Homo sapiens
ILISTLPSV

SEQ ID NO: 3776 - protein, 9 aa, Homo sapiens
ILLDNEFHV

SEQ ID NO: 3777 - protein, 9 aa, Homo sapiens
ILLDRLLYL

SEQ ID NO: 3778 - protein, 8 aa, Homo sapiens
ILLEHIIM

SEQ ID NO: 3779 - protein, 9 aa, Homo sapiens
ILLEKILSL

SEQ ID NO: 3780 - protein, 9 aa, Homo sapiens
ILLKDILSV

SEQ ID NO: 3781 - protein, 11 aa, Homo sapiens
ILLNPAYDVYL

SEQ ID NO: 3782 - protein, 9 aa, Homo sapiens
ILLPSVFGV

SEQ ID NO: 3783 - protein, 9 aa, Homo sapiens
ILLPYLQTL

SEQ ID NO: 3784 - protein, 9 aa, Homo sapiens
ILLSGIYNV

SEQ ID NO: 3785 - protein, 9 aa, Homo sapiens
ILLSVPLLV

SEQ ID NO: 3786 - protein, 10 aa, Homo sapiens
ILLSVPLLVV

SEQ ID NO: 3787 - protein, 10 aa, Homo sapiens
ILMDPSPEYA

SEQ ID NO: 3788 - protein, 10 aa, Homo sapiens
ILMSYDHVEL

SEQ ID NO: 3789 - protein, 11 aa, Homo sapiens
ILNPDNSFEIL

SEQ ID NO: 3790 - protein, 9 aa, Homo sapiens
ILNPEVVTV

SEQ ID NO: 3791 - protein, 9 aa, Homo sapiens
ILNPLLTLL

SEQ ID NO: 3792 - protein, 9 aa, Homo sapiens
ILPVPAFNV

SEQ ID NO: 3793 - protein, 10 aa, Homo sapiens
ILQDLQPFLV

SEQ ID NO: 3794 - protein, 9 aa, Homo sapiens
ILQNGLETL

SEQ ID NO: 3795 - protein, 9 aa, Homo sapiens
ILSETELHV

SEQ ID NO: 3796 - protein, 10 aa, Homo sapiens
ILSGIGVSQV

SEQ ID NO: 3797 - protein, 10 aa, Homo sapiens
ILSKDGVLYV

SEQ ID NO: 3798 - protein, 9 aa, Homo sapiens
ILSMQIPFV

SEQ ID NO: 3799 - protein, 9 aa, Homo sapiens
ILSPLNVFV

SEQ ID NO: 3800 - protein, 9 aa, Homo sapiens
ILSQYITFV

SEQ ID NO: 3801 - protein, 9 aa, Homo sapiens
ILTETINTV

SEQ ID NO: 3802 - protein, 8 aa, Homo sapiens
ILTLKYPI

SEQ ID NO: 3803 - protein, 9 aa, Homo sapiens
ILVDTVWAL

SEQ ID NO: 3804 - protein, 9 aa, Homo sapiens
ILVGLLHMV

SEQ ID NO: 3805 - protein, 9 aa, Homo sapiens
ILVQVIPVV

SEQ ID NO: 3806 - protein, 9 aa, Homo sapiens
ILWEHLEIL

SEQ ID NO: 3807 - protein, 9 aa, Homo sapiens
ILWETVPSM

SEQ ID NO: 3808 - protein, 9 aa, Homo sapiens
ILWKDVTEA

SEQ ID NO: 3809 - protein, 10 aa, Homo sapiens
ILYDIPDIRL

SEQ ID NO: 3810 - protein, 9 aa, Homo sapiens
ILYPKTLFL

SEQ ID NO: 3811 - protein, 9 aa, Homo sapiens
ILYPSTLFL

SEQ ID NO: 3812 - protein, 9 aa, Homo sapiens
ILYSKTEHL

SEQ ID NO: 3813 - protein, 9 aa, Homo sapiens
IQHDLIFSL

SEQ ID NO: 3814 - protein, 9 aa, Toxoplasma gondii  ME49
IQTAVRLLL

SEQ ID NO: 3815 - protein, 9 aa, Homo sapiens
ITTDVLYTI

SEQ ID NO: 3816 - protein, 9 aa, Homo sapiens
KAFTYTVAA

SEQ ID NO: 3817 - protein, 9 aa, Homo sapiens
KAMEKLESV

SEQ ID NO: 3818 - protein, 9 aa, Homo sapiens
KIAQFLESV

SEQ ID NO: 3819 - protein, 9 aa, Homo sapiens
KIDDTIRYL

SEQ ID NO: 3820 - protein, 11 aa, Homo sapiens
KIFEMGPVFTL

SEQ ID NO: 3821 - protein, 9 aa, Homo sapiens
KIGSIIFQV

SEQ ID NO: 3822 - protein, 12 aa, Homo sapiens
KIIAPPERKYSV

SEQ ID NO: 3823 - protein, 9 aa, Homo sapiens
KIIEYSVYL

SEQ ID NO: 3824 - protein, 9 aa, Homo sapiens
KILDELEKV

SEQ ID NO: 3825 - protein, 9 aa, Homo sapiens
KILDVLEEI

SEQ ID NO: 3826 - protein, 9 aa, Homo sapiens
KILPDLNTV

SEQ ID NO: 3827 - protein, 9 aa, Homo sapiens
KIMDYSLLL

SEQ ID NO: 3828 - protein, 9 aa, Homo sapiens
KISEVVELL

SEQ ID NO: 3829 - protein, 9 aa, Homo sapiens
KITTVIQHV

SEQ ID NO: 3830 - protein, 9 aa, Homo sapiens
KIVDFSYSV

SEQ ID NO: 3831 - protein, 9 aa, Homo sapiens
KIWDPVHRV

SEQ ID NO: 3832 - protein, 11 aa, Homo sapiens
KIWDVSVNSVV

SEQ ID NO: 3833 - protein, 9 aa, Homo sapiens
KLAEALPSL

SEQ ID NO: 3834 - protein, 10 aa, Homo sapiens
KLAEGAGIQL

SEQ ID NO: 3835 - protein, 10 aa, Homo sapiens
KLAELKQECL

SEQ ID NO: 3836 - protein, 10 aa, Homo sapiens
KLAEVGRVYL

SEQ ID NO: 3837 - protein, 9 aa, Homo sapiens
KLDPTKTTL

SEQ ID NO: 3838 - protein, 9 aa, Homo sapiens
KLDVGNAEV

SEQ ID NO: 3839 - protein, 9 aa, Homo sapiens
KLEDGPKFL

SEQ ID NO: 3840 - protein, 9 aa, Homo sapiens
KLFAGLVHV

SEQ ID NO: 3841 - protein, 9 aa, Homo sapiens
KLFAIPILL

SEQ ID NO: 3842 - protein, 9 aa, Homo sapiens
KLFDAPLSI

SEQ ID NO: 3843 - protein, 12 aa, Homo sapiens
KLFDDDDSGKIS

SEQ ID NO: 3844 - protein, 10 aa, Homo sapiens
KLFDDKLQNC

SEQ ID NO: 3845 - protein, 9 aa, Homo sapiens
KLFDTQQFL

SEQ ID NO: 3846 - protein, 8 aa, Homo sapiens
KLFGMIIT

SEQ ID NO: 3847 - protein, 9 aa, Homo sapiens
KLFGMIITI

SEQ ID NO: 3848 - protein, 11 aa, Homo sapiens
KLFNESHGIFL

SEQ ID NO: 3849 - protein, 9 aa, Homo sapiens
KLFNKFIGK

SEQ ID NO: 3850 - protein, 10 aa, Homo sapiens
KLFPDTPLAL

SEQ ID NO: 3851 - protein, 9 aa, Homo sapiens
KLFQGQLVL

SEQ ID NO: 3852 - protein, 9 aa, Homo sapiens
KLFTQIFGV

SEQ ID NO: 3853 - protein, 8 aa, Homo sapiens
KLGDFGLL

SEQ ID NO: 3854 - protein, 11 aa, Homo sapiens
KLGEFAKVLEL

SEQ ID NO: 3855 - protein, 9 aa, Homo sapiens
KLGEIVTTI

SEQ ID NO: 3856 - protein, 8 aa, Homo sapiens
KLGIAPQI

SEQ ID NO: 3857 - protein, 9 aa, Homo sapiens
KLHEAVRAV

SEQ ID NO: 3858 - protein, 9 aa, Homo sapiens
KLIANNTTV

SEQ ID NO: 3859 - protein, 9 aa, Homo sapiens
KLIAQNLEL

SEQ ID NO: 3860 - protein, 10 aa, Homo sapiens
KLIDETQDML

SEQ ID NO: 3861 - protein, 11 aa, Homo sapiens
KLIDFGSGALL

SEQ ID NO: 3862 - protein, 9 aa, Homo sapiens
KLIDKLDSL

SEQ ID NO: 3863 - protein, 9 aa, Homo sapiens
KLIDLEHLL

SEQ ID NO: 3864 - protein, 11 aa, Homo sapiens
KLIDLSQVMYL

SEQ ID NO: 3865 - protein, 10 aa, Homo sapiens
KLIGDTPIDT

SEQ ID NO: 3866 - protein, 9 aa, Homo sapiens
KLIGEVFNI

SEQ ID NO: 3867 - protein, 9 aa, Homo sapiens
KLIGQVHEV

SEQ ID NO: 3868 - protein, 10 aa, Homo sapiens
KLINDSVFFL

SEQ ID NO: 3869 - protein, 9 aa, Homo sapiens
KLIPLLLQL

SEQ ID NO: 3870 - protein, 10 aa, Homo sapiens
KLIQLPVVYV

SEQ ID NO: 3871 - protein, 9 aa, Homo sapiens
KLISELQKL

SEQ ID NO: 3872 - protein, 10 aa, Homo sapiens
KLKPGDLVGV

SEQ ID NO: 3873 - protein, 11 aa, Homo sapiens
KLLDDEQPLRL

SEQ ID NO: 3874 - protein, 10 aa, Homo sapiens
KLLDIPGLEV

SEQ ID NO: 3875 - protein, 9 aa, Homo sapiens
KLLDKISEL

SEQ ID NO: 3876 - protein, 11 aa, Homo sapiens
KLLDPEDVAVQ

SEQ ID NO: 3877 - protein, 9 aa, Homo sapiens
KLLDRETIS

SEQ ID NO: 3878 - protein, 8 aa, Homo sapiens
KLLEPVLL

SEQ ID NO: 3879 - protein, 10 aa, Homo sapiens
KLLEVNGVAL

SEQ ID NO: 3880 - protein, 9 aa, Homo sapiens
KLLFWVTEV

SEQ ID NO: 3881 - protein, 9 aa, Homo sapiens
KLLGSMEQV

SEQ ID NO: 3882 - protein, 9 aa, Homo sapiens
KLLNKIYEA

SEQ ID NO: 3883 - protein, 11 aa, Homo sapiens
KLLPADALVNC

SEQ ID NO: 3884 - protein, 9 aa, Homo sapiens
KLLPQLTYL

SEQ ID NO: 3885 - protein, 9 aa, Homo sapiens
KLLPSVTEL

SEQ ID NO: 3886 - protein, 10 aa, Homo sapiens
KLLSDPNYGV

SEQ ID NO: 3887 - protein, 9 aa, Homo sapiens
KLLSENTNL

SEQ ID NO: 3888 - protein, 9 aa, Homo sapiens
KLLSKFYEL

SEQ ID NO: 3889 - protein, 11 aa, Homo sapiens
KLMDEVAGIVA

SEQ ID NO: 3890 - protein, 10 aa, Homo sapiens
KLMDVGLIAI

SEQ ID NO: 3891 - protein, 9 aa, Homo sapiens
KLMELLEEI

SEQ ID NO: 3892 - protein, 9 aa, Homo sapiens
KLMQQQQEV

SEQ ID NO: 3893 - protein, 9 aa, Homo sapiens
KLMTALVNV

SEQ ID NO: 3894 - protein, 9 aa, Homo sapiens
KLNATNIEL

SEQ ID NO: 3895 - protein, 9 aa, Homo sapiens
KLNEMSYEL

SEQ ID NO: 3896 - protein, 9 aa, Homo sapiens
KLNVAPLAV

SEQ ID NO: 3897 - protein, 9 aa, Homo sapiens
KLPVPLESV

SEQ ID NO: 3898 - protein, 9 aa, Homo sapiens
KLQDGVHII

SEQ ID NO: 3899 - protein, 9 aa, Homo sapiens
KLQEEIPVL

SEQ ID NO: 3900 - protein, 9 aa, Homo sapiens
KLQEELNKV

SEQ ID NO: 3901 - protein, 9 aa, Homo sapiens
KLQEKIQEL

SEQ ID NO: 3902 - protein, 9 aa, Homo sapiens
KLQENLQQL

SEQ ID NO: 3903 - protein, 9 aa, Homo sapiens
KLQEQIHRV

SEQ ID NO: 3904 - protein, 8 aa, Homo sapiens
KLQNIMML

SEQ ID NO: 3905 - protein, 9 aa, Homo sapiens
KLQNIMMLL

SEQ ID NO: 3906 - protein, 9 aa, Homo sapiens
KLQNLNIFL

SEQ ID NO: 3907 - protein, 9 aa, Homo sapiens
KLQQHIFAV

SEQ ID NO: 3908 - protein, 9 aa, Homo sapiens
KLRHIVDEV

SEQ ID NO: 3909 - protein, 9 aa, Homo sapiens
KLSEIDVAL

SEQ ID NO: 3910 - protein, 9 aa, Homo sapiens
KLSELEAAL

SEQ ID NO: 3911 - protein, 9 aa, Homo sapiens
KLSLVAAML

SEQ ID NO: 3912 - protein, 9 aa, Homo sapiens
KLTEENTTL

SEQ ID NO: 3913 - protein, 9 aa, Homo sapiens
KLTEIRHEV

SEQ ID NO: 3914 - protein, 9 aa, Homo sapiens
KLTSVLEAV

SEQ ID NO: 3915 - protein, 9 aa, Homo sapiens
KLVDEEPQL

SEQ ID NO: 3916 - protein, 10 aa, Homo sapiens
KLVEFDFLGA

SEQ ID NO: 3917 - protein, 9 aa, Homo sapiens
KLVERLHMV

SEQ ID NO: 3918 - protein, 9 aa, Homo sapiens
KLVTTVTEI

SEQ ID NO: 3919 - protein, 9 aa, Homo sapiens
KLWDIINVN

SEQ ID NO: 3920 - protein, 10 aa, Homo sapiens
KLWDIINVNI

SEQ ID NO: 3921 - protein, 10 aa, Homo sapiens
KLWDISEVMV

SEQ ID NO: 3922 - protein, 9 aa, Homo sapiens
KLWDLEQQV

SEQ ID NO: 3923 - protein, 9 aa, Homo sapiens
KLWDLLYKL

SEQ ID NO: 3924 - protein, 10 aa, Homo sapiens
KLWDNELQYV

SEQ ID NO: 3925 - protein, 9 aa, Homo sapiens
KLWEGLTEL

SEQ ID NO: 3926 - protein, 9 aa, Homo sapiens
KLWEMDNML

SEQ ID NO: 3927 - protein, 10 aa, Homo sapiens
KLWEMDNMLI

SEQ ID NO: 3928 - protein, 11 aa, Homo sapiens
KLWEMDNMLIQ

SEQ ID NO: 3929 - protein, 9 aa, Homo sapiens
KLWKENPGL

SEQ ID NO: 3930 - protein, 9 aa, Homo sapiens
KLWNGLVKV

SEQ ID NO: 3931 - protein, 9 aa, Homo sapiens
KLWQTPLHV

SEQ ID NO: 3932 - protein, 9 aa, Homo sapiens
KLWSETFDV

SEQ ID NO: 3933 - protein, 10 aa, Homo sapiens
KLYAGAILEV

SEQ ID NO: 3934 - protein, 9 aa, Homo sapiens
KLYEAVPQL

SEQ ID NO: 3935 - protein, 10 aa, Homo sapiens
KLYESLLPFA

SEQ ID NO: 3936 - protein, 9 aa, Homo sapiens
KLYGKPIRV

SEQ ID NO: 3937 - protein, 9 aa, Homo sapiens
KLYKNLLYL

SEQ ID NO: 3938 - protein, 10 aa, Homo sapiens
KLYNPENIYL

SEQ ID NO: 3939 - protein, 11 aa, Homo sapiens
KMADEDALRKI

SEQ ID NO: 3940 - protein, 9 aa, Homo sapiens
KMAELVHFL

SEQ ID NO: 3941 - protein, 11 aa, Homo sapiens
KMDDPDYWRTV

SEQ ID NO: 3942 - protein, 9 aa, Homo sapiens
KMDESKHEI

SEQ ID NO: 3943 - protein, 9 aa, Homo sapiens
KMFSDEILL

SEQ ID NO: 3944 - protein, 9 aa, Homo sapiens
KMHARDFTV

SEQ ID NO: 3945 - protein, 10 aa, Homo sapiens
KMIEDLQNEL

SEQ ID NO: 3946 - protein, 9 aa, Homo sapiens
KMSELRVTL

SEQ ID NO: 3947 - protein, 9 aa, Homo sapiens
KMVEDLISV

SEQ ID NO: 3948 - protein, 10 aa, Homo sapiens
KMWEELPEVV

SEQ ID NO: 3949 - protein, 8 aa, Homo sapiens
KQFTTVVA

SEQ ID NO: 3950 - protein, 10 aa, Homo sapiens
KQVDFLNWEV

SEQ ID NO: 3951 - protein, 9 aa, Homo sapiens
KRGDVIYIL

SEQ ID NO: 3952 - protein, 12 aa, Homo sapiens
KTDPSILGGMIV

SEQ ID NO: 3953 - protein, 10 aa, Homo sapiens
KTFPGFFSPM

SEQ ID NO: 3954 - protein, 10 aa, Homo sapiens
KTIEDTLMTV

SEQ ID NO: 3955 - protein, 9 aa, Homo sapiens
KTIQQLETV

SEQ ID NO: 3956 - protein, 9 aa, Homo sapiens
KTKEGVLYV

SEQ ID NO: 3957 - protein, 9 aa, Homo sapiens
KTLEGEFSV

SEQ ID NO: 3958 - protein, 9 aa, Homo sapiens
KTYDKTVAL

SEQ ID NO: 3959 - protein, 9 aa, Homo sapiens
KVIDYVPGI

SEQ ID NO: 3960 - protein, 9 aa, Homo sapiens
KVLDLKINL

SEQ ID NO: 3961 - protein, 9 aa, Homo sapiens
KVLDLRINL

SEQ ID NO: 3962 - protein, 9 aa, Homo sapiens
KVVGKDYLL

SEQ ID NO: 3963 - protein, 9 aa, Homo sapiens
KVWGNVVTV

SEQ ID NO: 3964 - protein, 9 aa, Homo sapiens
LAAEFLKQV

SEQ ID NO: 3965 - protein, 8 aa, Homo sapiens
LADLVHHV

SEQ ID NO: 3966 - protein, 12 aa, Homo sapiens
LALNEDLRSWTA

SEQ ID NO: 3967 - protein, 9 aa, Homo sapiens
LIDPNTLQV

SEQ ID NO: 3968 - protein, 9 aa, Homo sapiens
LILESIPVV

SEQ ID NO: 3969 - protein, 9 aa, Homo sapiens
LIMDMIPAI

SEQ ID NO: 3970 - protein, 9 aa, Homo sapiens
LIWPLLSTV

SEQ ID NO: 3971 - protein, 9 aa, Homo sapiens
LLAEALNQV

SEQ ID NO: 3972 - protein, 9 aa, Homo sapiens
LLAEPVPGI

SEQ ID NO: 3973 - protein, 9 aa, Homo sapiens
LLAEQGYEV

SEQ ID NO: 3974 - protein, 9 aa, Homo sapiens
LLAPIRVLL

SEQ ID NO: 3975 - protein, 9 aa, Homo sapiens
LLARPSLLL

SEQ ID NO: 3976 - protein, 9 aa, Homo sapiens
LLASEVPQL

SEQ ID NO: 3977 - protein, 9 aa, Homo sapiens
LLATVLQAV

SEQ ID NO: 3978 - protein, 9 aa, Homo sapiens
LLDHAPPEI

SEQ ID NO: 3979 - protein, 9 aa, Homo sapiens
LLDHVLLTL

SEQ ID NO: 3980 - protein, 8 aa, Homo sapiens
LLDKLYAL

SEQ ID NO: 3981 - protein, 8 aa, Homo sapiens
LLDRFLAT

SEQ ID NO: 3982 - protein, 9 aa, Homo sapiens
LLDSAPLNV

SEQ ID NO: 3983 - protein, 9 aa, Homo sapiens
LLDVQPHTV

SEQ ID NO: 3984 - protein, 9 aa, Homo sapiens
LLFDSVIHL

SEQ ID NO: 3985 - protein, 9 aa, Homo sapiens
LLFERATFL

SEQ ID NO: 3986 - protein, 10 aa, Homo sapiens
LLFPFYIPSA

SEQ ID NO: 3987 - protein, 9 aa, Homo sapiens
LLHEENFSV

SEQ ID NO: 3988 - protein, 9 aa, Homo sapiens
LLHELLTHV

SEQ ID NO: 3989 - protein, 8 aa, Homo sapiens
LLIENVAS

SEQ ID NO: 3990 - protein, 9 aa, Homo sapiens
LLIPGLATA

SEQ ID NO: 3991 - protein, 9 aa, Homo sapiens
LLIPVVPGV

SEQ ID NO: 3992 - protein, 9 aa, Homo sapiens
LLLEILHEI

SEQ ID NO: 3993 - protein, 9 aa, Homo sapiens
LLLETLPEL

SEQ ID NO: 3994 - protein, 9 aa, Homo sapiens
LLLKGVEAV

SEQ ID NO: 3995 - protein, 9 aa, Homo sapiens
LLLNSTQSV

SEQ ID NO: 3996 - protein, 8 aa, Homo sapiens
LLLPDYYL

SEQ ID NO: 3997 - protein, 9 aa, Homo sapiens
LLLPDYYLV

SEQ ID NO: 3998 - protein, 10 aa, Homo sapiens
LLLPDYYLVT

SEQ ID NO: 3999 - protein, 11 aa, Homo sapiens
LLLPDYYLVTV

SEQ ID NO: 4000 - protein, 9 aa, Homo sapiens
LLLPFLPQV

SEQ ID NO: 4001 - protein, 9 aa, Homo sapiens
LLLPISPFM

SEQ ID NO: 4002 - protein, 10 aa, Homo sapiens
LLLPTGVFQV

SEQ ID NO: 4003 - protein, 9 aa, Homo sapiens
LLLSVLPQL

SEQ ID NO: 4004 - protein, 9 aa, Homo sapiens
LLMATILHL

SEQ ID NO: 4005 - protein, 9 aa, Homo sapiens
LLMIFSHQL

SEQ ID NO: 4006 - protein, 9 aa, Homo sapiens
LLMVLSPRL

SEQ ID NO: 4007 - protein, 9 aa, Homo sapiens
LLNEILEQV

SEQ ID NO: 4008 - protein, 9 aa, Homo sapiens
LLNEQELQL

SEQ ID NO: 4009 - protein, 9 aa, Homo sapiens
LLNPVVEFV

SEQ ID NO: 4010 - protein, 9 aa, Homo sapiens
LLPDNFIAA

SEQ ID NO: 4011 - protein, 9 aa, Homo sapiens
LLPDNVHYV

SEQ ID NO: 4012 - protein, 9 aa, Homo sapiens
LLPEGPPAI

SEQ ID NO: 4013 - protein, 9 aa, Homo sapiens
LLPISPFML

SEQ ID NO: 4014 - protein, 11 aa, Homo sapiens
LLPPLESLATV

SEQ ID NO: 4015 - protein, 9 aa, Homo sapiens
LLPPPPCPA

SEQ ID NO: 4016 - protein, 11 aa, Homo sapiens
LLQDGEFSMDL

SEQ ID NO: 4017 - protein, 9 aa, Homo sapiens
LLREVGTAL

SEQ ID NO: 4018 - protein, 9 aa, Homo sapiens
LLSHVIVAL

SEQ ID NO: 4019 - protein, 9 aa, Homo sapiens
LLSPVVPQI

SEQ ID NO: 4020 - protein, 11 aa, Homo sapiens
LLVPTSGIYFV

SEQ ID NO: 4021 - protein, 9 aa, Homo sapiens
LLVSGFWGV

SEQ ID NO: 4022 - protein, 8 aa, Homo sapiens
LLWDYVYQ

SEQ ID NO: 4023 - protein, 9 aa, Homo sapiens
LLWDYVYQL

SEQ ID NO: 4024 - protein, 9 aa, Homo sapiens
LLWERVEKL

SEQ ID NO: 4025 - protein, 9 aa, Homo sapiens
LLWGNLPEI

SEQ ID NO: 4026 - protein, 10 aa, Homo sapiens
LLWPGAALLV

SEQ ID NO: 4027 - protein, 10 aa, Homo sapiens
LLYTGDLEAL

SEQ ID NO: 4028 - protein, 9 aa, Homo sapiens
LLYYQTNYL

SEQ ID NO: 4029 - protein, 9 aa, Homo sapiens
LMAPYTPFL

SEQ ID NO: 4030 - protein, 9 aa, Homo sapiens
LMDHTIPEV

SEQ ID NO: 4031 - protein, 9 aa, Homo sapiens
LMYPYIFHV

SEQ ID NO: 4032 - protein, 9 aa, Homo sapiens
LSLENLEKI

SEQ ID NO: 4033 - protein, 9 aa, Homo sapiens
LSLMLVSTV

SEQ ID NO: 4034 - protein, 10 aa, Homo sapiens
LTIEDGIFEV

SEQ ID NO: 4035 - protein, 9 aa, Homo sapiens
MALLFSLIL

SEQ ID NO: 4036 - protein, 9 aa, Homo sapiens
MIAQTVTAV

SEQ ID NO: 4037 - protein, 9 aa, Homo sapiens
MISELEVRL

SEQ ID NO: 4038 - protein, 9 aa, Homo sapiens
MITPFLPVV

SEQ ID NO: 4039 - protein, 9 aa, Homo sapiens
MLAEKLPNL

SEQ ID NO: 4040 - protein, 9 aa, Homo sapiens
MLDMSVPAV

SEQ ID NO: 4041 - protein, 9 aa, Homo sapiens
MLDSLRIYL

SEQ ID NO: 4042 - protein, 9 aa, Homo sapiens
MLEVALTLI

SEQ ID NO: 4043 - protein, 11 aa, Homo sapiens
MLFGHPLLVSV

SEQ ID NO: 4044 - protein, 10 aa, Homo sapiens
MLGVNQGEGL

SEQ ID NO: 4045 - protein, 9 aa, Homo sapiens
MLHSVTLFL

SEQ ID NO: 4046 - protein, 9 aa, Homo sapiens
MLIGEIFEL

SEQ ID NO: 4047 - protein, 11 aa, Homo sapiens
MLLATLLLLLL

SEQ ID NO: 4048 - protein, 8 aa, Homo sapiens
MLLENIIL

SEQ ID NO: 4049 - protein, 10 aa, Homo sapiens
MLLPASDPLL

SEQ ID NO: 4050 - protein, 10 aa, Homo sapiens
MLLPGPLHSL

SEQ ID NO: 4051 - protein, 9 aa, Homo sapiens
MLYDIVPVV

SEQ ID NO: 4052 - protein, 12 aa, Homo sapiens
MMDQARSAFSNL

SEQ ID NO: 4053 - protein, 10 aa, Homo sapiens
MMHFKSGLEL

SEQ ID NO: 4054 - protein, 8 aa, Homo sapiens
MMPTPVIL

SEQ ID NO: 4055 - protein, 9 aa, Homo sapiens
MMPTPVILL

SEQ ID NO: 4056 - protein, 10 aa, Homo sapiens
MMTAKAVDKI

SEQ ID NO: 4057 - protein, 9 aa, Homo sapiens
MTDKAPPGV

SEQ ID NO: 4058 - protein, 8 aa, Homo sapiens
MVDGTLLL

SEQ ID NO: 4059 - protein, 9 aa, Homo sapiens
NIFPYPVGV

SEQ ID NO: 4060 - protein, 9 aa, Homo sapiens
NLAKCIVSV

SEQ ID NO: 4061 - protein, 9 aa, Homo sapiens
NLASFIEQV

SEQ ID NO: 4062 - protein, 9 aa, Homo sapiens
NLFDRVVTL

SEQ ID NO: 4063 - protein, 9 aa, Homo sapiens
NLFNKYPAL

SEQ ID NO: 4064 - protein, 10 aa, Homo sapiens
NLIDLDDLYV

SEQ ID NO: 4065 - protein, 9 aa, Homo sapiens
NLINQEIML

SEQ ID NO: 4066 - protein, 9 aa, Homo sapiens
NLISALEEA

SEQ ID NO: 4067 - protein, 11 aa, Homo sapiens
NLLDDRGMTAL

SEQ ID NO: 4068 - protein, 9 aa, Homo sapiens
NLLEEVFHL

SEQ ID NO: 4069 - protein, 9 aa, Homo sapiens
NLLKLIAEV

SEQ ID NO: 4070 - protein, 9 aa, Homo sapiens
NLLTHIENV

SEQ ID NO: 4071 - protein, 9 aa, Homo sapiens
NLVAIPVYV

SEQ ID NO: 4072 - protein, 9 aa, Homo sapiens
NLVSFLETV

SEQ ID NO: 4073 - protein, 9 aa, Homo sapiens
NLYPETFAL

SEQ ID NO: 4074 - protein, 10 aa, Homo sapiens
NMFGTKFETV

SEQ ID NO: 4075 - protein, 10 aa, Homo sapiens
NQIGAKFWEV

SEQ ID NO: 4076 - protein, 8 aa, Homo sapiens
PLAKIIPI

SEQ ID NO: 4077 - protein, 10 aa, Homo sapiens
PLMLPPPLEL

SEQ ID NO: 4078 - protein, 9 aa, Homo sapiens
PLPVQVFNL

SEQ ID NO: 4079 - protein, 9 aa, Homo sapiens
QLAIPVSSL

SEQ ID NO: 4080 - protein, 9 aa, Homo sapiens
QLFQGVLTL

SEQ ID NO: 4081 - protein, 9 aa, Homo sapiens
QLIKELPEL

SEQ ID NO: 4082 - protein, 9 aa, Homo sapiens
QLIPKLIFL

SEQ ID NO: 4083 - protein, 9 aa, Homo sapiens
QLLEKVPTL

SEQ ID NO: 4084 - protein, 9 aa, Homo sapiens
QLLPLIVNL

SEQ ID NO: 4085 - protein, 9 aa, Homo sapiens
QLMEQVAQL

SEQ ID NO: 4086 - protein, 9 aa, Homo sapiens
QLMQQMIQL

SEQ ID NO: 4087 - protein, 9 aa, Homo sapiens
QLMREVLLL

SEQ ID NO: 4088 - protein, 9 aa, Homo sapiens
QLQEELEKV

SEQ ID NO: 4089 - protein, 9 aa, Homo sapiens
QLQPGNAKL

SEQ ID NO: 4090 - protein, 9 aa, Homo sapiens
QLSPRLLEV

SEQ ID NO: 4091 - protein, 9 aa, Homo sapiens
QLSPVLLYL

SEQ ID NO: 4092 - protein, 9 aa, Homo sapiens
QLWNNYFHL

SEQ ID NO: 4093 - protein, 9 aa, Homo sapiens
QLYNQIIKL

SEQ ID NO: 4094 - protein, 9 aa, Homo sapiens
QMISRIEYV

SEQ ID NO: 4095 - protein, 9 aa, Homo sapiens
QQIDRVVEV

SEQ ID NO: 4096 - protein, 9 aa, Homo sapiens
QQIGKVVQV

SEQ ID NO: 4097 - protein, 8 aa, Homo sapiens
VIPVLPQV

SEQ ID NO: 4098 - protein, 9 aa, Homo sapiens
RIIDTVAQV

SEQ ID NO: 4099 - protein, 9 aa, Homo sapiens
RIPAYFVTV

SEQ ID NO: 4100 - protein, 9 aa, Homo sapiens
RIRPTAVTL

SEQ ID NO: 4101 - protein, 9 aa, Homo sapiens
RLAHYIDRV

SEQ ID NO: 4102 - protein, 11 aa, Homo sapiens
RLAHYNKRSTI

SEQ ID NO: 4103 - protein, 9 aa, Homo sapiens
RLAPAQWFL

SEQ ID NO: 4104 - protein, 9 aa, Homo sapiens
RLDDAIHVL

SEQ ID NO: 4105 - protein, 9 aa, Homo sapiens
RLDEAFDFV

SEQ ID NO: 4106 - protein, 11 aa, Homo sapiens
RLFDDSTVTTV

SEQ ID NO: 4107 - protein, 11 aa, Homo sapiens
RLFDEPQLASL

SEQ ID NO: 4108 - protein, 9 aa, Homo sapiens
RLFDQAFGL

SEQ ID NO: 4109 - protein, 9 aa, Homo sapiens
RLFHKTVYL

SEQ ID NO: 4110 - protein, 10 aa, Homo sapiens
RLFNDPVAMV

SEQ ID NO: 4111 - protein, 10 aa, Homo sapiens
RLFPGAPPTA

SEQ ID NO: 4112 - protein, 9 aa, Homo sapiens
RLFSSIVTV

SEQ ID NO: 4113 - protein, 9 aa, Homo sapiens
RLHEKIQEA

SEQ ID NO: 4114 - protein, 9 aa, Homo sapiens
RLIAQRYLL

SEQ ID NO: 4115 - protein, 9 aa, Homo sapiens
RLIDLGVGL

SEQ ID NO: 4116 - protein, 10 aa, Homo sapiens
RLIDLPGTEL

SEQ ID NO: 4117 - protein, 9 aa, Homo sapiens
RLIEETISI

SEQ ID NO: 4118 - protein, 10 aa, Homo sapiens
RLIEETQIFQ

SEQ ID NO: 4119 - protein, 11 aa, Homo sapiens
RLIEETQIFQM

SEQ ID NO: 4120 - protein, 9 aa, Homo sapiens
RLIEQEEYL

SEQ ID NO: 4121 - protein, 8 aa, Homo sapiens
RLIESLFT

SEQ ID NO: 4122 - protein, 9 aa, Homo sapiens
RLIESLFTI

SEQ ID NO: 4123 - protein, 9 aa, Homo sapiens
RLIEVTETI

SEQ ID NO: 4124 - protein, 11 aa, Homo sapiens
RLIGDAAKNQV

SEQ ID NO: 4125 - protein, 9 aa, Homo sapiens
RLINQVLEL

SEQ ID NO: 4126 - protein, 9 aa, Homo sapiens
RLIPIIVLL

SEQ ID NO: 4127 - protein, 9 aa, Homo sapiens
RLIPTLVSI

SEQ ID NO: 4128 - protein, 9 aa, Homo sapiens
RLISKFDTV

SEQ ID NO: 4129 - protein, 10 aa, Homo sapiens
RLLDLENIQI

SEQ ID NO: 4130 - protein, 9 aa, Homo sapiens
RLLDLENSL

SEQ ID NO: 4131 - protein, 9 aa, Homo sapiens
RLLDRKVLL

SEQ ID NO: 4132 - protein, 9 aa, Homo sapiens
RLLDYVATV

SEQ ID NO: 4133 - protein, 9 aa, Homo sapiens
RLLEATSYL

SEQ ID NO: 4134 - protein, 9 aa, Homo sapiens
RLLETVIDV

SEQ ID NO: 4135 - protein, 9 aa, Homo sapiens
RLLEVPVML

SEQ ID NO: 4136 - protein, 9 aa, Homo sapiens
RLLGYVATL

SEQ ID NO: 4137 - protein, 9 aa, Homo sapiens
RLLHEMILV

SEQ ID NO: 4138 - protein, 9 aa, Homo sapiens
RLLLPGELA

SEQ ID NO: 4139 - protein, 12 aa, Homo sapiens
RLLLPGELAKHA

SEQ ID NO: 4140 - protein, 11 aa, Homo sapiens
RLLPPGAVVAV

SEQ ID NO: 4141 - protein, 9 aa, Homo sapiens
RLLPQVDSV

SEQ ID NO: 4142 - protein, 9 aa, Homo sapiens
RLLPVIFLV

SEQ ID NO: 4143 - protein, 11 aa, Homo sapiens
RLLQDSVDFSL

SEQ ID NO: 4144 - protein, 9 aa, Homo sapiens
RLLQTLPQL

SEQ ID NO: 4145 - protein, 9 aa, Homo sapiens
RLMDNSTSV

SEQ ID NO: 4146 - protein, 9 aa, Homo sapiens
RLMNDMTAV

SEQ ID NO: 4147 - protein, 9 aa, Homo sapiens
RLMNETTAV

SEQ ID NO: 4148 - protein, 11 aa, Homo sapiens
RLMNETTAVAL

SEQ ID NO: 4149 - protein, 9 aa, Homo sapiens
RLNEAAVTV

SEQ ID NO: 4150 - protein, 10 aa, Homo sapiens
RLPDDDPTAV

SEQ ID NO: 4151 - protein, 9 aa, Homo sapiens
RLPDLIIFL

SEQ ID NO: 4152 - protein, 9 aa, Homo sapiens
RLPEAIEEV

SEQ ID NO: 4153 - protein, 9 aa, Homo sapiens
RLPEIYIQL

SEQ ID NO: 4154 - protein, 9 aa, Homo sapiens
RLPPPFPGL

SEQ ID NO: 4155 - protein, 9 aa, Homo sapiens
RLQEDLQSV

SEQ ID NO: 4156 - protein, 9 aa, Homo sapiens
RLQEEVHLL

SEQ ID NO: 4157 - protein, 11 aa, Homo sapiens
RLQEGDKILSV

SEQ ID NO: 4158 - protein, 9 aa, Homo sapiens
RLSDAQIYV

SEQ ID NO: 4159 - protein, 9 aa, Homo sapiens
RLSEAIVTV

SEQ ID NO: 4160 - protein, 10 aa, Homo sapiens
RLSEFIPAVF

SEQ ID NO: 4161 - protein, 9 aa, Homo sapiens
RLSEVQASL

SEQ ID NO: 4162 - protein, 9 aa, Homo sapiens
RLTDYVAFL

SEQ ID NO: 4163 - protein, 9 aa, Homo sapiens
RLVPFLVEL

SEQ ID NO: 4164 - protein, 9 aa, Homo sapiens
RLVPFLVFV

SEQ ID NO: 4165 - protein, 11 aa, Homo sapiens
RLWDHATMTEV

SEQ ID NO: 4166 - protein, 9 aa, Homo sapiens
RLWGEPVNL

SEQ ID NO: 4167 - protein, 11 aa, Homo sapiens
RLWNMPENNGL

SEQ ID NO: 4168 - protein, 9 aa, Homo sapiens
RLWPKIQGL

SEQ ID NO: 4169 - protein, 9 aa, Homo sapiens
RLYHELVGL

SEQ ID NO: 4170 - protein, 11 aa, Homo sapiens
RLYSGISGLEL

SEQ ID NO: 4171 - protein, 9 aa, Homo sapiens
RMFGIPVVV

SEQ ID NO: 4172 - protein, 11 aa, Homo sapiens
RQLEEEGITFV

SEQ ID NO: 4173 - protein, 10 aa, Homo sapiens
RQYPWGVVQV

SEQ ID NO: 4174 - protein, 9 aa, Homo sapiens
RTIGVITKL

SEQ ID NO: 4175 - protein, 9 aa, Homo sapiens
RVMPSSFFL

SEQ ID NO: 4176 - protein, 9 aa, Homo sapiens
RVPPVPPNV

SEQ ID NO: 4177 - protein, 8 aa, Homo sapiens
RVSDINFT

SEQ ID NO: 4178 - protein, 11 aa, Homo sapiens
RVWDISTVSSV

SEQ ID NO: 4179 - protein, 9 aa, Homo sapiens
RVYERLLYV

SEQ ID NO: 4180 - protein, 9 aa, Homo sapiens
SAFPFPVTV

SEQ ID NO: 4181 - protein, 9 aa, Homo sapiens
SIIEYLPTL

SEQ ID NO: 4182 - protein, 9 aa, Homo sapiens
SIISNLITV

SEQ ID NO: 4183 - protein, 9 aa, Homo sapiens
SILEAVPQV

SEQ ID NO: 4184 - protein, 9 aa, Homo sapiens
SILEHQIQV

SEQ ID NO: 4185 - protein, 9 aa, Homo sapiens
SILHDVVEV

SEQ ID NO: 4186 - protein, 9 aa, Homo sapiens
SILSSLTSV

SEQ ID NO: 4187 - protein, 9 aa, Homo sapiens
SIRDFLVTL

SEQ ID NO: 4188 - protein, 9 aa, Homo sapiens
SISPIVLYL

SEQ ID NO: 4189 - protein, 10 aa, Homo sapiens
SIYGGFLLGV

SEQ ID NO: 4190 - protein, 9 aa, Homo sapiens
SIYPSPTGV

SEQ ID NO: 4191 - protein, 9 aa, Homo sapiens
SLAADIPRL

SEQ ID NO: 4192 - protein, 8 aa, Homo sapiens
SLAALKKA

SEQ ID NO: 4193 - protein, 10 aa, Homo sapiens
SLAALKKALA

SEQ ID NO: 4194 - protein, 11 aa, Homo sapiens
SLAALKKALAA

SEQ ID NO: 4195 - protein, 12 aa, Homo sapiens
SLAALKKALAAA

SEQ ID NO: 4196 - protein, 10 aa, Homo sapiens
SLADLQNDEV

SEQ ID NO: 4197 - protein, 9 aa, Homo sapiens
SLAEVLQQL

SEQ ID NO: 4198 - protein, 11 aa, Homo sapiens
SLAGDVALQQL

SEQ ID NO: 4199 - protein, 9 aa, Homo sapiens
SLAPLFFKL

SEQ ID NO: 4200 - protein, 9 aa, Homo sapiens
SLAQYLINA

SEQ ID NO: 4201 - protein, 9 aa, Homo sapiens
SLAWDVPAA

SEQ ID NO: 4202 - protein, 11 aa, Homo sapiens
SLDAAAGMLYL

SEQ ID NO: 4203 - protein, 10 aa, Homo sapiens
SLDDLQPWHS

SEQ ID NO: 4204 - protein, 9 aa, Homo sapiens
SLDKFLASV

SEQ ID NO: 4205 - protein, 11 aa, Homo sapiens
SLDKFLASVST

SEQ ID NO: 4206 - protein, 9 aa, Homo sapiens
SLDKTSHSV

SEQ ID NO: 4207 - protein, 9 aa, Homo sapiens
SLFERLVVL

SEQ ID NO: 4208 - protein, 9 aa, Homo sapiens
SLFNKLVEL

SEQ ID NO: 4209 - protein, 10 aa, Homo sapiens
SLFPGKLEVV

SEQ ID NO: 4210 - protein, 9 aa, Homo sapiens
SLHDAIMIV

SEQ ID NO: 4211 - protein, 10 aa, Homo sapiens
SLHPDLIYNV

SEQ ID NO: 4212 - protein, 9 aa, Homo sapiens
SLIAKVATA

SEQ ID NO: 4213 - protein, 9 aa, Homo sapiens
SLIDADPYL

SEQ ID NO: 4214 - protein, 9 aa, Homo sapiens
SLIDGYYRL

SEQ ID NO: 4215 - protein, 9 aa, Homo sapiens
SLIDIVTEI

SEQ ID NO: 4216 - protein, 10 aa, Homo sapiens
SLINVGLISV

SEQ ID NO: 4217 - protein, 9 aa, Homo sapiens
SLIPTSPQV

SEQ ID NO: 4218 - protein, 9 aa, Homo sapiens
SLIRNLEQL

SEQ ID NO: 4219 - protein, 9 aa, Homo sapiens
SLISTILEV

SEQ ID NO: 4220 - protein, 9 aa, Homo sapiens
SLISVIHLI

SEQ ID NO: 4221 - protein, 9 aa, Homo sapiens
SLITRLLEV

SEQ ID NO: 4222 - protein, 10 aa, Homo sapiens
SLKEEVGEEA

SEQ ID NO: 4223 - protein, 11 aa, Homo sapiens
SLKEEVGEEAI

SEQ ID NO: 4224 - protein, 9 aa, Homo sapiens
SLLASLHTL

SEQ ID NO: 4225 - protein, 9 aa, Homo sapiens
SLLDEFYKL

SEQ ID NO: 4226 - protein, 10 aa, Homo sapiens
SLLDGVVEKL

SEQ ID NO: 4227 - protein, 8 aa, Homo sapiens
SLLDRFLA

SEQ ID NO: 4228 - protein, 9 aa, Homo sapiens
SLLDRFLAT

SEQ ID NO: 4229 - protein, 10 aa, Homo sapiens
SLLDRFLATV

SEQ ID NO: 4230 - protein, 9 aa, Homo sapiens
SLLDSCTKL

SEQ ID NO: 4231 - protein, 9 aa, Homo sapiens
SLLEPFVYL

SEQ ID NO: 4232 - protein, 11 aa, Homo sapiens
SLLGDDALVQV

SEQ ID NO: 4233 - protein, 9 aa, Homo sapiens
SLLGHLMIV

SEQ ID NO: 4234 - protein, 11 aa, Homo sapiens
SLLHLGALYGI

SEQ ID NO: 4235 - protein, 9 aa, Homo sapiens
SLLPFLKAV

SEQ ID NO: 4236 - protein, 10 aa, Homo sapiens
SLLPVKPVEI

SEQ ID NO: 4237 - protein, 9 aa, Homo sapiens
SLLPYLPML

SEQ ID NO: 4238 - protein, 9 aa, Homo sapiens
SLLRSIFTV

SEQ ID NO: 4239 - protein, 9 aa, Homo sapiens
SLLSHVEQL

SEQ ID NO: 4240 - protein, 9 aa, Homo sapiens
SLLSNDLKL

SEQ ID NO: 4241 - protein, 9 aa, Homo sapiens
SLLYNVPAV

SEQ ID NO: 4242 - protein, 10 aa, Homo sapiens
SLMDHTIPEV

SEQ ID NO: 4243 - protein, 11 aa, Homo sapiens
SLMEPPAVLLL

SEQ ID NO: 4244 - protein, 9 aa, Homo sapiens
SLMMTIINL

SEQ ID NO: 4245 - protein, 9 aa, Homo sapiens
SLMSHAIEL

SEQ ID NO: 4246 - protein, 10 aa, Homo sapiens
SLPDFGISYV

SEQ ID NO: 4247 - protein, 10 aa, Homo sapiens
SLPSARPLSL

SEQ ID NO: 4248 - protein, 9 aa, Homo sapiens
SLQERQVFL

SEQ ID NO: 4249 - protein, 9 aa, Homo sapiens
SLQSTILGV

SEQ ID NO: 4250 - protein, 9 aa, Homo sapiens
SLSEKQYFL

SEQ ID NO: 4251 - protein, 9 aa, Homo sapiens
SLTGHISTV

SEQ ID NO: 4252 - protein, 9 aa, Homo sapiens
SLVAILQSV

SEQ ID NO: 4253 - protein, 9 aa, Homo sapiens
SLVATLQSL

SEQ ID NO: 4254 - protein, 9 aa, Homo sapiens
SLVDGYFRL

SEQ ID NO: 4255 - protein, 9 aa, Homo sapiens
SLVDTVYAL

SEQ ID NO: 4256 - protein, 9 aa, Homo sapiens
SLVSKGTLV

SEQ ID NO: 4257 - protein, 11 aa, Homo sapiens
SLVSKGTLVQT

SEQ ID NO: 4258 - protein, 11 aa, Homo sapiens
SLVSPASYENV

SEQ ID NO: 4259 - protein, 9 aa, Homo sapiens
SLWFKPEEL

SEQ ID NO: 4260 - protein, 9 aa, Homo sapiens
SLWHLPLLL

SEQ ID NO: 4261 - protein, 9 aa, Homo sapiens
SLWPMTFGL

SEQ ID NO: 4262 - protein, 9 aa, Homo sapiens
SLYASGRTT

SEQ ID NO: 4263 - protein, 9 aa, Homo sapiens
SLYDYNPNL

SEQ ID NO: 4264 - protein, 9 aa, Homo sapiens
SLYKGLLSV

SEQ ID NO: 4265 - protein, 9 aa, Homo sapiens
SLYREILFL

SEQ ID NO: 4266 - protein, 11 aa, Homo sapiens
SMADIPLGFGV

SEQ ID NO: 4267 - protein, 9 aa, Homo sapiens
SMTLVNVLV

SEQ ID NO: 4268 - protein, 9 aa, Homo sapiens
SNIDKSLYV

SEQ ID NO: 4269 - protein, 9 aa, Homo sapiens
SQDPGTHVV

SEQ ID NO: 4270 - protein, 9 aa, Homo sapiens
SQLPFKVEA

SEQ ID NO: 4271 - protein, 8 aa, Homo sapiens
SVALLMNL

SEQ ID NO: 4272 - protein, 9 aa, Homo sapiens
SVDWPESSL

SEQ ID NO: 4273 - protein, 9 aa, Homo sapiens
SVIEQIVYV

SEQ ID NO: 4274 - protein, 11 aa, Homo sapiens
TEVLKTHGLLV

SEQ ID NO: 4275 - protein, 9 aa, Homo sapiens
TILPKVMQV

SEQ ID NO: 4276 - protein, 9 aa, Homo sapiens
TLADIIARL

SEQ ID NO: 4277 - protein, 9 aa, Homo sapiens
TLDDLIAAV

SEQ ID NO: 4278 - protein, 9 aa, Homo sapiens
TLDEATPTL

SEQ ID NO: 4279 - protein, 9 aa, Homo sapiens
TLFPVRLLV

SEQ ID NO: 4280 - protein, 9 aa, Homo sapiens
TLGNVLVTV

SEQ ID NO: 4281 - protein, 10 aa, Homo sapiens
TLHGLQQYYV

SEQ ID NO: 4282 - protein, 9 aa, Homo sapiens
TLIDSLDTL

SEQ ID NO: 4283 - protein, 9 aa, Homo sapiens
TLIEDILGV

SEQ ID NO: 4284 - protein, 9 aa, Homo sapiens
TLIPYYISV

SEQ ID NO: 4285 - protein, 9 aa, Homo sapiens
TLISDIEAV

SEQ ID NO: 4286 - protein, 9 aa, Homo sapiens
TLISELVQA

SEQ ID NO: 4287 - protein, 11 aa, Homo sapiens
TLLAAEFLKQV

SEQ ID NO: 4288 - protein, 11 aa, Homo sapiens
TLLDPNEKYLL

SEQ ID NO: 4289 - protein, 9 aa, Homo sapiens
TLLEKDYFL

SEQ ID NO: 4290 - protein, 9 aa, Homo sapiens
TLLKKVWKV

SEQ ID NO: 4291 - protein, 9 aa, Homo sapiens
TLLNSTLFL

SEQ ID NO: 4292 - protein, 9 aa, Homo sapiens
TLLPLRVFL

SEQ ID NO: 4293 - protein, 9 aa, Homo sapiens
TLLRLLYEA

SEQ ID NO: 4294 - protein, 9 aa, Homo sapiens
TLMGHMLYL

SEQ ID NO: 4295 - protein, 9 aa, Homo sapiens
TLNNLEIFL

SEQ ID NO: 4296 - protein, 9 aa, Homo sapiens
TLQEVHFLL

SEQ ID NO: 4297 - protein, 9 aa, Homo sapiens
TLSDIMVSL

SEQ ID NO: 4298 - protein, 9 aa, Homo sapiens
TLSDIVVTL

SEQ ID NO: 4299 - protein, 9 aa, Homo sapiens
TLSEVTNQL

SEQ ID NO: 4300 - protein, 9 aa, Homo sapiens
TLVDFPLHL

SEQ ID NO: 4301 - protein, 9 aa, Homo sapiens
TLVGSLPLL

SEQ ID NO: 4302 - protein, 9 aa, Homo sapiens
TLYNTEVLL

SEQ ID NO: 4303 - protein, 9 aa, Homo sapiens
TMLARLASA

SEQ ID NO: 4304 - protein, 8 aa, Homo sapiens
TTAEREIV

SEQ ID NO: 4305 - protein, 9 aa, Homo sapiens
TTFKNLQTV

SEQ ID NO: 4306 - protein, 9 aa, Homo sapiens
TTFPRPVTV

SEQ ID NO: 4307 - protein, 12 aa, Homo sapiens
TTLLLPISPFML

SEQ ID NO: 4308 - protein, 10 aa, Homo sapiens
TVFPAGLANV

SEQ ID NO: 4309 - protein, 12 aa, Homo sapiens
TVGGTAYAIYEL

SEQ ID NO: 4310 - protein, 9 aa, Homo sapiens
TVLDAIYEV

SEQ ID NO: 4311 - protein, 9 aa, Homo sapiens
TVLPFVSTV

SEQ ID NO: 4312 - protein, 9 aa, Homo sapiens
TVMGKIFAV

SEQ ID NO: 4313 - protein, 11 aa, Homo sapiens
TVWPTMITPML

SEQ ID NO: 4314 - protein, 9 aa, Homo sapiens
VALEHFVLV

SEQ ID NO: 4315 - protein, 8 aa, Homo sapiens
VAPEEHPV

SEQ ID NO: 4316 - protein, 9 aa, Homo sapiens
VFDNYSANV

SEQ ID NO: 4317 - protein, 10 aa, Homo sapiens
VIADGGIQNV

SEQ ID NO: 4318 - protein, 9 aa, Homo sapiens
VILHHEYFL

SEQ ID NO: 4319 - protein, 9 aa, Homo sapiens
VILPTVHEV

SEQ ID NO: 4320 - protein, 9 aa, Homo sapiens
VLADQVWTL

SEQ ID NO: 4321 - protein, 9 aa, Homo sapiens
VLAETLTQV

SEQ ID NO: 4322 - protein, 9 aa, Homo sapiens
VLAPLVIYL

SEQ ID NO: 4323 - protein, 9 aa, Homo sapiens
VLAWGLLNV

SEQ ID NO: 4324 - protein, 9 aa, Homo sapiens
VLAYFLPEA

SEQ ID NO: 4325 - protein, 9 aa, Homo sapiens
VLDDKLYVV

SEQ ID NO: 4326 - protein, 9 aa, Homo sapiens
VLFGKPMVV

SEQ ID NO: 4327 - protein, 9 aa, Homo sapiens
VLFGLLREV

SEQ ID NO: 4328 - protein, 9 aa, Homo sapiens
VLFPMDLAL

SEQ ID NO: 4329 - protein, 11 aa, Homo sapiens
VLFSSPPVILL

SEQ ID NO: 4330 - protein, 9 aa, Homo sapiens
VLIANLEKL

SEQ ID NO: 4331 - protein, 9 aa, Homo sapiens
VLIDHDVDL

SEQ ID NO: 4332 - protein, 9 aa, Homo sapiens
VLIDVLKEL

SEQ ID NO: 4333 - protein, 10 aa, Homo sapiens
VLIEGSINSV

SEQ ID NO: 4334 - protein, 10 aa, Homo sapiens
VLIGEFLEKV

SEQ ID NO: 4335 - protein, 10 aa, Homo sapiens
VLIKNLLVSV

SEQ ID NO: 4336 - protein, 10 aa, Homo sapiens
VLINDADWEL

SEQ ID NO: 4337 - protein, 9 aa, Homo sapiens
VLIQDVPTL

SEQ ID NO: 4338 - protein, 9 aa, Homo sapiens
VLISKLPYI

SEQ ID NO: 4339 - protein, 9 aa, Homo sapiens
VLLDAPIQL

SEQ ID NO: 4340 - protein, 9 aa, Homo sapiens
VLLDSVEKL

SEQ ID NO: 4341 - protein, 10 aa, Homo sapiens
VLLDYHLNYL

SEQ ID NO: 4342 - protein, 9 aa, Homo sapiens
VLLESEQFL

SEQ ID NO: 4343 - protein, 12 aa, Homo sapiens
VLLESEQFLTEL

SEQ ID NO: 4344 - protein, 8 aa, Homo sapiens
VLLGHIFY

SEQ ID NO: 4345 - protein, 9 aa, Homo sapiens
VLLQIVHFL

SEQ ID NO: 4346 - protein, 9 aa, Homo sapiens
VLLSHLSYL

SEQ ID NO: 4347 - protein, 10 aa, Homo sapiens
VLLSIPFVSV

SEQ ID NO: 4348 - protein, 10 aa, Homo sapiens
VLMDRLPSLL

SEQ ID NO: 4349 - protein, 10 aa, Homo sapiens
VLMEKPDVVV

SEQ ID NO: 4350 - protein, 9 aa, Homo sapiens
VLMENIVYL

SEQ ID NO: 4351 - protein, 9 aa, Homo sapiens
VLMGSLVYL

SEQ ID NO: 4352 - protein, 9 aa, Homo sapiens
VLMLQEPLL

SEQ ID NO: 4353 - protein, 9 aa, Homo sapiens
VLMPWIHEL

SEQ ID NO: 4354 - protein, 10 aa, Homo sapiens
VLPNFLPYNV

SEQ ID NO: 4355 - protein, 8 aa, Homo sapiens
VLQDIQVM

SEQ ID NO: 4356 - protein, 9 aa, Homo sapiens
VLQDIQVML

SEQ ID NO: 4357 - protein, 9 aa, Homo sapiens
VLQEKIEVV

SEQ ID NO: 4358 - protein, 9 aa, Homo sapiens
VLQGKLAEV

SEQ ID NO: 4359 - protein, 9 aa, Homo sapiens
VLSDIIQNL

SEQ ID NO: 4360 - protein, 11 aa, Homo sapiens
VLSDIIQNLSV

SEQ ID NO: 4361 - protein, 11 aa, Homo sapiens
VLSGGTTMYPG

SEQ ID NO: 4362 - protein, 9 aa, Homo sapiens
VLSNVEVTL

SEQ ID NO: 4363 - protein, 9 aa, Homo sapiens
VLTGILEQV

SEQ ID NO: 4364 - protein, 9 aa, Homo sapiens
VLTGLSIRL

SEQ ID NO: 4365 - protein, 9 aa, Homo sapiens
VLTSVTEAL

SEQ ID NO: 4366 - protein, 10 aa, Homo sapiens
VLVPYEPPQV

SEQ ID NO: 4367 - protein, 9 aa, Homo sapiens
VLWAGTPMV

SEQ ID NO: 4368 - protein, 8 aa, Homo sapiens
VLWDRTFS

SEQ ID NO: 4369 - protein, 10 aa, Homo sapiens
VLWDRTFSLF

SEQ ID NO: 4370 - protein, 9 aa, Homo sapiens
VLWFKPVEL

SEQ ID NO: 4371 - protein, 9 aa, Homo sapiens
VLWKEILFL

SEQ ID NO: 4372 - protein, 9 aa, Homo sapiens
VLWPLPAYL

SEQ ID NO: 4373 - protein, 11 aa, Homo sapiens
VLYEEVEELRL

SEQ ID NO: 4374 - protein, 11 aa, Homo sapiens
VLYNEIEYAQA

SEQ ID NO: 4375 - protein, 9 aa, Homo sapiens
VLYNESLQL

SEQ ID NO: 4376 - protein, 9 aa, Homo sapiens
VLYSVMTLV

SEQ ID NO: 4377 - protein, 8 aa, Homo sapiens
VMAPRALL

SEQ ID NO: 4378 - protein, 9 aa, Homo sapiens
VMIPTLPSI

SEQ ID NO: 4379 - protein, 9 aa, Homo sapiens
VMITKLVEV

SEQ ID NO: 4380 - protein, 10 aa, Homo sapiens
VMLETVPRSG

SEQ ID NO: 4381 - protein, 9 aa, Homo sapiens
VMTLVSTYL

SEQ ID NO: 4382 - protein, 9 aa, Homo sapiens
VMVTNLVEV

SEQ ID NO: 4383 - protein, 9 aa, Homo sapiens
VMVTTVPLV

SEQ ID NO: 4384 - protein, 9 aa, Homo sapiens
VQNDTLLQV

SEQ ID NO: 4385 - protein, 8 aa, Homo sapiens
VQSLPLPL

SEQ ID NO: 4386 - protein, 12 aa, Homo sapiens
VQSMDVAAFNKI

SEQ ID NO: 4387 - protein, 10 aa, Homo sapiens
VTSIAKAPAV

SEQ ID NO: 4388 - protein, 9 aa, Homo sapiens
VVAEFVPLI

SEQ ID NO: 4389 - protein, 9 aa, Homo sapiens
VVDQGSTNL

SEQ ID NO: 4390 - protein, 9 aa, Homo sapiens
VVLPAPPAV

SEQ ID NO: 4391 - protein, 9 aa, Homo sapiens
WIMPDNIFL

SEQ ID NO: 4392 - protein, 10 aa, Homo sapiens
WLLPYNGVTV

SEQ ID NO: 4393 - protein, 9 aa, Homo sapiens
WLMPVIPAL

SEQ ID NO: 4394 - protein, 9 aa, Homo sapiens
WLTPVIPAL

SEQ ID NO: 4395 - protein, 9 aa, Homo sapiens
WMLEQLRQV

SEQ ID NO: 4396 - protein, 9 aa, Homo sapiens
YAFAHILTV

SEQ ID NO: 4397 - protein, 9 aa, Homo sapiens
YAFNMKATV

SEQ ID NO: 4398 - protein, 9 aa, Homo sapiens
YAFPKAVSV

SEQ ID NO: 4399 - protein, 9 aa, Homo sapiens
YAYDGKDYL

SEQ ID NO: 4400 - protein, 9 aa, Homo sapiens
YFAERVTSL

SEQ ID NO: 4401 - protein, 11 aa, Homo sapiens
YFGSAFATPFL

SEQ ID NO: 4402 - protein, 9 aa, Homo sapiens
YIDDTLTMV

SEQ ID NO: 4403 - protein, 8 aa, Homo sapiens
YIFEEPFT

SEQ ID NO: 4404 - protein, 9 aa, Homo sapiens
YIFEEPFTI

SEQ ID NO: 4405 - protein, 9 aa, Homo sapiens
YLADIFTKL

SEQ ID NO: 4406 - protein, 9 aa, Homo sapiens
YLADLYHFV

SEQ ID NO: 4407 - protein, 9 aa, Homo sapiens
YLADTVQKL

SEQ ID NO: 4408 - protein, 9 aa, Homo sapiens
YLADVTNAL

SEQ ID NO: 4409 - protein, 10 aa, Homo sapiens
YLAEKYEWDV

SEQ ID NO: 4410 - protein, 10 aa, Homo sapiens
YLAELVTPIL

SEQ ID NO: 4411 - protein, 9 aa, Homo sapiens
YLAHFIEGL

SEQ ID NO: 4412 - protein, 9 aa, Homo sapiens
YLDAIKLLL

SEQ ID NO: 4413 - protein, 9 aa, Homo sapiens
YLDASLITV

SEQ ID NO: 4414 - protein, 9 aa, Homo sapiens
YLDNGVVFV

SEQ ID NO: 4415 - protein, 10 aa, Homo sapiens
YLDPSVLSGV

SEQ ID NO: 4416 - protein, 11 aa, Homo sapiens
YLDQTVVPILL

SEQ ID NO: 4417 - protein, 11 aa, Homo sapiens
YLEELPEKLKL

SEQ ID NO: 4418 - protein, 10 aa, Homo sapiens
YLFDRNGVCL

SEQ ID NO: 4419 - protein, 8 aa, Homo sapiens
YLFGERLL

SEQ ID NO: 4420 - protein, 8 aa, Homo sapiens
YLFHVQEV

SEQ ID NO: 4421 - protein, 9 aa, Homo sapiens
YLFNSVVNV

SEQ ID NO: 4422 - protein, 10 aa, Homo sapiens
YLFPATVVGV

SEQ ID NO: 4423 - protein, 9 aa, Homo sapiens
YLFPGIPEL

SEQ ID NO: 4424 - protein, 10 aa, Homo sapiens
YLFPGIPELL

SEQ ID NO: 4425 - protein, 9 aa, Homo sapiens
YLGDVSERV

SEQ ID NO: 4426 - protein, 9 aa, Homo sapiens
YLGEGPRMV

SEQ ID NO: 4427 - protein, 9 aa, Homo sapiens
YLGNINPQM

SEQ ID NO: 4428 - protein, 9 aa, Homo sapiens
YLHDFLKYL

SEQ ID NO: 4429 - protein, 11 aa, Homo sapiens
YLHDQNPDAAL

SEQ ID NO: 4430 - protein, 9 aa, Homo sapiens
YLHSQVVSV

SEQ ID NO: 4431 - protein, 9 aa, Homo sapiens
YLHSYLTYI

SEQ ID NO: 4432 - protein, 10 aa, Homo sapiens
YLIDEPSAYL

SEQ ID NO: 4433 - protein, 9 aa, Homo sapiens
YLIELIDRV

SEQ ID NO: 4434 - protein, 9 aa, Homo sapiens
YLIEPDVEL

SEQ ID NO: 4435 - protein, 9 aa, Homo sapiens
YLIKYIAIV

SEQ ID NO: 4436 - protein, 10 aa, Homo sapiens
YLIPDIDLKL

SEQ ID NO: 4437 - protein, 8 aa, Homo sapiens
YLIPLLER

SEQ ID NO: 4438 - protein, 9 aa, Homo sapiens
YLIPLLERL

SEQ ID NO: 4439 - protein, 9 aa, Homo sapiens
YLITLLEHL

SEQ ID NO: 4440 - protein, 9 aa, Homo sapiens
YLLDLHSYL

SEQ ID NO: 4441 - protein, 9 aa, Homo sapiens
YLLENGLNL

SEQ ID NO: 4442 - protein, 9 aa, Homo sapiens
YLLPKDIKL

SEQ ID NO: 4443 - protein, 8 aa, Homo sapiens
YLLPSVVL

SEQ ID NO: 4444 - protein, 9 aa, Homo sapiens
YLLPSVVLL

SEQ ID NO: 4445 - protein, 8 aa, Homo sapiens
YLLPYENL

SEQ ID NO: 4446 - protein, 9 aa, Homo sapiens
YLLPYENLL

SEQ ID NO: 4447 - protein, 9 aa, Homo sapiens
YLLQEIYGI

SEQ ID NO: 4448 - protein, 9 aa, Homo sapiens
YLMLPAPML

SEQ ID NO: 4449 - protein, 9 aa, Homo sapiens
YLNNVVEQL

SEQ ID NO: 4450 - protein, 9 aa, Homo sapiens
YLPAVFEEV

SEQ ID NO: 4451 - protein, 9 aa, Homo sapiens
YLPELLQTV

SEQ ID NO: 4452 - protein, 9 aa, Homo sapiens
YLPPATQVV

SEQ ID NO: 4453 - protein, 9 aa, Homo sapiens
YLQDKIYEV

SEQ ID NO: 4454 - protein, 10 aa, Homo sapiens
YLQEVPILTL

SEQ ID NO: 4455 - protein, 9 aa, Homo sapiens
YLQNWSHVL

SEQ ID NO: 4456 - protein, 9 aa, Homo sapiens
YLREQGKAL

SEQ ID NO: 4457 - protein, 10 aa, Homo sapiens
YLSDTTVTML

SEQ ID NO: 4458 - protein, 9 aa, Homo sapiens
YLSEATIGL

SEQ ID NO: 4459 - protein, 11 aa, Homo sapiens
YLSEDVFQHAV

SEQ ID NO: 4460 - protein, 9 aa, Homo sapiens
YLSEEVQAV

SEQ ID NO: 4461 - protein, 9 aa, Homo sapiens
YLSSVITTI

SEQ ID NO: 4462 - protein, 9 aa, Homo sapiens
YLTAEILEL

SEQ ID NO: 4463 - protein, 9 aa, Homo sapiens
YLTAEVLEL

SEQ ID NO: 4464 - protein, 9 aa, Homo sapiens
YLTHDSPSV

SEQ ID NO: 4465 - protein, 9 aa, Homo sapiens
YLTNVNTTV

SEQ ID NO: 4466 - protein, 9 aa, Homo sapiens
YLTPLILTL

SEQ ID NO: 4467 - protein, 9 aa, Homo sapiens
YLVPELDGV

SEQ ID NO: 4468 - protein, 9 aa, Homo sapiens
YLVPSDLTV

SEQ ID NO: 4469 - protein, 9 aa, Homo sapiens
YLVSHPNEV

SEQ ID NO: 4470 - protein, 9 aa, Homo sapiens
YLVSNVIEL

SEQ ID NO: 4471 - protein, 9 aa, Homo sapiens
YLVVKIEKV

SEQ ID NO: 4472 - protein, 10 aa, Homo sapiens
YLYGQTTTYL

SEQ ID NO: 4473 - protein, 9 aa, Homo sapiens
YLYNEGLSV

SEQ ID NO: 4474 - protein, 9 aa, Homo sapiens
YLYTDTVDL

SEQ ID NO: 4475 - protein, 9 aa, Homo sapiens
YMIDNVILL

SEQ ID NO: 4476 - protein, 9 aa, Homo sapiens
YMYHHPTSA

SEQ ID NO: 4477 - protein, 10 aa, Homo sapiens
YQKFLPLTQV

SEQ ID NO: 4478 - protein, 9 aa, Homo sapiens
YQLELRTTL

SEQ ID NO: 4479 - protein, 9 aa, Homo sapiens
YQTEIGQTL

SEQ ID NO: 4480 - protein, 9 aa, Homo sapiens
YQVGQLYSV

SEQ ID NO: 4481 - protein, 9 aa, Homo sapiens
YQYPRPLLI

SEQ ID NO: 4482 - protein, 9 aa, Homo sapiens
YTSPVNPAV

SEQ ID NO: 4483 - protein, 9 aa, Homo sapiens
YVINDLTAV

SEQ ID NO: 4484 - protein, 9 aa, Homo sapiens
YVLPVVSYI

SEQ ID NO: 4485 - protein, 8 aa, Homo sapiens
YVPRAILV

SEQ ID NO: 4486 - protein, 9 aa, Homo sapiens
YVSDLELSA

SEQ ID NO: 4487 - protein, 9 aa, Homo sapiens
YVYEYLLHV

SEQ ID NO: 4488 - protein, 9 aa, Homo sapiens
KASEKIFYV

SEQ ID NO: 4489 - protein, 9 aa, Homo sapiens
AAALIIHHV

SEQ ID NO: 4490 - protein, 11 aa, Homo sapiens
AAMAAQGEPQV

SEQ ID NO: 4491 - protein, 10 aa, Homo sapiens
AAMVYNEFIL

SEQ ID NO: 4492 - protein, 10 aa, Homo sapiens
AIIDGKIFCV

SEQ ID NO: 4493 - protein, 9 aa, Homo sapiens
AILEKMPLV

SEQ ID NO: 4494 - protein, 9 aa, Homo sapiens
AIMDIVIKV

SEQ ID NO: 4495 - protein, 9 aa, Homo sapiens
AIMDLLLRL

SEQ ID NO: 4496 - protein, 11 aa, Homo sapiens
ALAAPDIVPAL

SEQ ID NO: 4497 - protein, 10 aa, Homo sapiens
ALAASALPAL

SEQ ID NO: 4498 - protein, 9 aa, Homo sapiens
ALAATNPAV

SEQ ID NO: 4499 - protein, 11 aa, Homo sapiens
ALADFAELLRA

SEQ ID NO: 4500 - protein, 9 aa, Homo sapiens
ALADFLPVM

SEQ ID NO: 4501 - protein, 10 aa, Homo sapiens
ALADGVTMQV

SEQ ID NO: 4502 - protein, 10 aa, Homo sapiens
ALADGVVSQA

SEQ ID NO: 4503 - protein, 10 aa, Homo sapiens
ALADIAQSQL

SEQ ID NO: 4504 - protein, 9 aa, Homo sapiens
ALADVATVL

SEQ ID NO: 4505 - protein, 9 aa, Homo sapiens
ALADVMSQL

SEQ ID NO: 4506 - protein, 11 aa, Homo sapiens
ALADVPELARL

SEQ ID NO: 4507 - protein, 9 aa, Homo sapiens
ALAEDPQEL

SEQ ID NO: 4508 - protein, 10 aa, Homo sapiens
ALAEGLDIKL

SEQ ID NO: 4509 - protein, 9 aa, Homo sapiens
ALAEGQLRL

SEQ ID NO: 4510 - protein, 11 aa, Homo sapiens
ALAEIPGVRSV

SEQ ID NO: 4511 - protein, 9 aa, Homo sapiens
ALAEKLDRL

SEQ ID NO: 4512 - protein, 10 aa, Homo sapiens
ALAELIDNSL

SEQ ID NO: 4513 - protein, 9 aa, Homo sapiens
ALAEQVQKA

SEQ ID NO: 4514 - protein, 9 aa, Homo sapiens
ALAERLDIV

SEQ ID NO: 4515 - protein, 11 aa, Homo sapiens
ALAEVAAMENV

SEQ ID NO: 4516 - protein, 9 aa, Homo sapiens
ALAGDQPSV

SEQ ID NO: 4517 - protein, 9 aa, Homo sapiens
ALAGGITMV

SEQ ID NO: 4518 - protein, 9 aa, Homo sapiens
ALAGIVTNV

SEQ ID NO: 4519 - protein, 11 aa, Homo sapiens
ALAGPEVEAHL

SEQ ID NO: 4520 - protein, 9 aa, Homo sapiens
ALAGVNPQL

SEQ ID NO: 4521 - protein, 9 aa, Homo sapiens
ALAKDMALA

SEQ ID NO: 4522 - protein, 10 aa, Homo sapiens
ALAKGEVTEM

SEQ ID NO: 4523 - protein, 10 aa, Homo sapiens
ALAKPPVVSV

SEQ ID NO: 4524 - protein, 8 aa, Homo sapiens
ALALTQTW

SEQ ID NO: 4525 - protein, 9 aa, Homo sapiens
ALAPAPPQV

SEQ ID NO: 4526 - protein, 11 aa, Homo sapiens
ALAPASTQSPA

SEQ ID NO: 4527 - protein, 10 aa, Homo sapiens
ALAPDLAQAP

SEQ ID NO: 4528 - protein, 9 aa, Homo sapiens
ALAPGRGPS

SEQ ID NO: 4529 - protein, 9 aa, Homo sapiens
ALAPHLDDA

SEQ ID NO: 4530 - protein, 9 aa, Homo sapiens
ALAPPPPAA

SEQ ID NO: 4531 - protein, 9 aa, Homo sapiens
ALAPSPAAA

SEQ ID NO: 4532 - protein, 8 aa, Homo sapiens
ALAPSSPL

SEQ ID NO: 4533 - protein, 9 aa, Homo sapiens
ALAPTPSAV

SEQ ID NO: 4534 - protein, 9 aa, Homo sapiens
ALAQADRLI

SEQ ID NO: 4535 - protein, 9 aa, Artificial Sequence
  unknown
ALARSILPA

SEQ ID NO: 4536 - protein, 9 aa, Artificial Sequence
  unknown
ALARTALAL

SEQ ID NO: 4537 - protein, 9 aa, Homo sapiens
ALASHILTA

SEQ ID NO: 4538 - protein, 9 aa, Homo sapiens
ALASISHVA

SEQ ID NO: 4539 - protein, 9 aa, Homo sapiens
ALASVAYQV

SEQ ID NO: 4540 - protein, 9 aa, Homo sapiens
ALASVIKEL

SEQ ID NO: 4541 - protein, 9 aa, Homo sapiens
ALATHILSL

SEQ ID NO: 4542 - protein, 9 aa, Homo sapiens
ALATKLLSL

SEQ ID NO: 4543 - protein, 8 aa, Homo sapiens
ALATLYAL

SEQ ID NO: 4544 - protein, 9 aa, Homo sapiens
ALAVNISAA

SEQ ID NO: 4545 - protein, 10 aa, Homo sapiens
ALCEENMRGV

SEQ ID NO: 4546 - protein, 10 aa, Artificial Sequence
  unknown
ALCTMGIQEL

SEQ ID NO: 4547 - protein, 11 aa, Homo sapiens
ALDEAGQRSTM

SEQ ID NO: 4548 - protein, 10 aa, Homo sapiens
ALDEGDIALL

SEQ ID NO: 4549 - protein, 9 aa, Toxoplasma gondii ME49
ALDEPTTNL

SEQ ID NO: 4550 - protein, 9 aa, Homo sapiens
ALDHMVEYV

SEQ ID NO: 4551 - protein, 9 aa, Homo sapiens
ALDIMIPMV

SEQ ID NO: 4552 - protein, 11 aa, Homo sapiens
ALDSGASLLHL

SEQ ID NO: 4553 - protein, 9 aa, Homo sapiens
ALEARVAQL

SEQ ID NO: 4554 - protein, 9 aa, Homo sapiens
ALEDRVWEL

SEQ ID NO: 4555 - protein, 9 aa, Homo sapiens
ALEHRVYEV

SEQ ID NO: 4556 - protein, 9 aa, Homo sapiens
ALEKKQGQL

SEQ ID NO: 4557 - protein, 9 aa, Homo sapiens
ALEPIDITV

SEQ ID NO: 4558 - protein, 9 aa, Homo sapiens
ALFDAQAQV

SEQ ID NO: 4559 - protein, 11 aa, Homo sapiens
ALFEAAREVTL

SEQ ID NO: 4560 - protein, 11 aa, Homo sapiens
ALFEESGLIRI

SEQ ID NO: 4561 - protein, 10 aa, Homo sapiens
ALFEGVVRQI

SEQ ID NO: 4562 - protein, 9 aa, Homo sapiens
ALFISPALI

SEQ ID NO: 4563 - protein, 9 aa, Homo sapiens
ALFKDAWLL

SEQ ID NO: 4564 - protein, 9 aa, Homo sapiens
ALFPERITV

SEQ ID NO: 4565 - protein, 11 aa, Homo sapiens
ALFPVAEDISL

SEQ ID NO: 4566 - protein, 9 aa, Homo sapiens
ALGAPPPPA

SEQ ID NO: 4567 - protein, 10 aa, Homo sapiens
ALGDKFLLRV

SEQ ID NO: 4568 - protein, 9 aa, Homo sapiens
ALGDQILFV

SEQ ID NO: 4569 - protein, 11 aa, Homo sapiens
ALGEEALLRYV

SEQ ID NO: 4570 - protein, 11 aa, Homo sapiens
ALGFYPAEITL

SEQ ID NO: 4571 - protein, 9 aa, Homo sapiens
ALGGAPYQV

SEQ ID NO: 4572 - protein, 9 aa, Homo sapiens
ALGHVIVLL

SEQ ID NO: 4573 - protein, 9 aa, Homo sapiens
ALGPVPPEA

SEQ ID NO: 4574 - protein, 9 aa, Homo sapiens
ALGPVWAAL

SEQ ID NO: 4575 - protein, 9 aa, Homo sapiens
ALGQMPISP

SEQ ID NO: 4576 - protein, 9 aa, Homo sapiens
ALGSFIYHL

SEQ ID NO: 4577 - protein, 9 aa, Homo sapiens
ALGVDLKEV

SEQ ID NO: 4578 - protein, 9 aa, Homo sapiens
ALHAAVIAI

SEQ ID NO: 4579 - protein, 9 aa, Homo sapiens
ALHARMETV

SEQ ID NO: 4580 - protein, 9 aa, Homo sapiens
ALHHAVIFL

SEQ ID NO: 4581 - protein, 9 aa, Homo sapiens
ALHLRSWLL

SEQ ID NO: 4582 - protein, 9 aa, Homo sapiens
ALHQILVLL

SEQ ID NO: 4583 - protein, 9 aa, Homo sapiens
ALHWFLNQV

SEQ ID NO: 4584 - protein, 10 aa, Homo sapiens
ALIENLTHQI

SEQ ID NO: 4585 - protein, 10 aa, Homo sapiens
ALIEQKLNEA

SEQ ID NO: 4586 - protein, 9 aa, Homo sapiens
ALIEQKVEL

SEQ ID NO: 4587 - protein, 11 aa, Homo sapiens
ALIEVPDGFTA

SEQ ID NO: 4588 - protein, 9 aa, Homo sapiens
ALIGMSPQV

SEQ ID NO: 4589 - protein, 11 aa, Homo sapiens
ALILEPSLYTV

SEQ ID NO: 4590 - protein, 9 aa, Homo sapiens
ALINKLDFA

SEQ ID NO: 4591 - protein, 9 aa, Homo sapiens
ALINNIVEI

SEQ ID NO: 4592 - protein, 11 aa, Homo sapiens
ALINNIVEIRV

SEQ ID NO: 4593 - protein, 9 aa, Homo sapiens
ALINTQALL

SEQ ID NO: 4594 - protein, 11 aa, Homo sapiens
ALIPETTTLTV

SEQ ID NO: 4595 - protein, 9 aa, Homo sapiens
ALIQQATTV

SEQ ID NO: 4596 - protein, 10 aa, Homo sapiens
ALIRLDDLFL

SEQ ID NO: 4597 - protein, 10 aa, Homo sapiens
ALISEKLETL

SEQ ID NO: 4598 - protein, 10 aa, Homo sapiens
ALISRGLEWV

SEQ ID NO: 4599 - protein, 8 aa, Homo sapiens
ALITAALY

SEQ ID NO: 4600 - protein, 11 aa, Homo sapiens
ALITDPDEMRM

SEQ ID NO: 4601 - protein, 9 aa, Homo sapiens
ALITEVVRL

SEQ ID NO: 4602 - protein, 9 aa, Homo sapiens
ALITTILHL

SEQ ID NO: 4603 - protein, 9 aa, Homo sapiens
ALKPDLVNV

SEQ ID NO: 4604 - protein, 9 aa, Homo sapiens
ALLAYTLGV

SEQ ID NO: 4605 - protein, 9 aa, Homo sapiens
ALLDGRLQV

SEQ ID NO: 4606 - protein, 9 aa, Homo sapiens
ALLDGRVQL

SEQ ID NO: 4607 - protein, 10 aa, Homo sapiens
ALLDGTVFEI

SEQ ID NO: 4608 - protein, 11 aa, Homo sapiens
ALLDKDLQIEV

SEQ ID NO: 4609 - protein, 10 aa, Homo sapiens
ALLDQALSNA

SEQ ID NO: 4610 - protein, 10 aa, Homo sapiens
ALLDQLHTLL

SEQ ID NO: 4611 - protein, 9 aa, Homo sapiens
ALLDQTKTL

SEQ ID NO: 4612 - protein, 11 aa, Homo sapiens
ALLEADVNIKL

SEQ ID NO: 4613 - protein, 11 aa, Homo sapiens
ALLEDSVIRQA

SEQ ID NO: 4614 - protein, 11 aa, Homo sapiens
ALLEENSTPQL

SEQ ID NO: 4615 - protein, 9 aa, Homo sapiens
ALLEEVKAL

SEQ ID NO: 4616 - protein, 10 aa, Homo sapiens
ALLEEVKALL

SEQ ID NO: 4617 - protein, 9 aa, Homo sapiens
ALLEKLTEL

SEQ ID NO: 4618 - protein, 11 aa, Homo sapiens
ALLEKPGELSL

SEQ ID NO: 4619 - protein, 9 aa, Homo sapiens
ALLELLHEL

SEQ ID NO: 4620 - protein, 10 aa, Homo sapiens
ALLELVPWRA

SEQ ID NO: 4621 - protein, 11 aa, Homo sapiens
ALLENGIIHHV

SEQ ID NO: 4622 - protein, 11 aa, Homo sapiens
ALLEPEFILKA

SEQ ID NO: 4623 - protein, 11 aa, Homo sapiens
ALLEPGGVLTI

SEQ ID NO: 4624 - protein, 11 aa, Homo sapiens
ALLEQTGDMSL

SEQ ID NO: 4625 - protein, 10 aa, Homo sapiens
ALLESVLRHV

SEQ ID NO: 4626 - protein, 9 aa, Homo sapiens
ALLGELARL

SEQ ID NO: 4627 - protein, 9 aa, Homo sapiens
ALLGHNVGD

SEQ ID NO: 4628 - protein, 9 aa, Homo sapiens
ALLGKLDAI

SEQ ID NO: 4629 - protein, 11 aa, Homo sapiens
ALLGKLDAINV

SEQ ID NO: 4630 - protein, 9 aa, Homo sapiens
ALLGRLAEL

SEQ ID NO: 4631 - protein, 9 aa, Homo sapiens
ALLHKTIQL

SEQ ID NO: 4632 - protein, 9 aa, Homo sapiens
ALLHTVTSI

SEQ ID NO: 4633 - protein, 10 aa, Homo sapiens
ALLKDSIVQL

SEQ ID NO: 4634 - protein, 9 aa, Homo sapiens
ALLKHLEGI

SEQ ID NO: 4635 - protein, 9 aa, Homo sapiens
ALLKQIQEA

SEQ ID NO: 4636 - protein, 9 aa, Homo sapiens
ALLKVNQEL

SEQ ID NO: 4637 - protein, 9 aa, Homo sapiens
ALLKYIETL

SEQ ID NO: 4638 - protein, 10 aa, Homo sapiens
ALLLPPVTLA

SEQ ID NO: 4639 - protein, 10 aa, Homo sapiens
ALLMLGGGLL

SEQ ID NO: 4640 - protein, 10 aa, Homo sapiens
ALLNAILHSA

SEQ ID NO: 4641 - protein, 9 aa, Homo sapiens
ALLNEAKEV

SEQ ID NO: 4642 - protein, 9 aa, Homo sapiens
ALLNTINYL

SEQ ID NO: 4643 - protein, 11 aa, Homo sapiens
ALLPASGQIAL

SEQ ID NO: 4644 - protein, 11 aa, Homo sapiens
ALLPEPNHVML

SEQ ID NO: 4645 - protein, 10 aa, Homo sapiens
ALLPGSPVEA

SEQ ID NO: 4646 - protein, 9 aa, Homo sapiens
ALLPHLYTL

SEQ ID NO: 4647 - protein, 11 aa, Homo sapiens
ALLPVASRLLL

SEQ ID NO: 4648 - protein, 9 aa, Homo sapiens
ALLQDLHKA

SEQ ID NO: 4649 - protein, 9 aa, Homo sapiens
ALLQEIVNI

SEQ ID NO: 4650 - protein, 9 aa, Homo sapiens
ALLQEVYKL

SEQ ID NO: 4651 - protein, 10 aa, Homo sapiens
ALLQGAIESV

SEQ ID NO: 4652 - protein, 9 aa, Homo sapiens
ALLQKLQQL

SEQ ID NO: 4653 - protein, 11 aa, Homo sapiens
ALLQQMEELKL

SEQ ID NO: 4654 - protein, 9 aa, Homo sapiens
ALLQRLEAL

SEQ ID NO: 4655 - protein, 10 aa, Homo sapiens
ALLRDGIELV

SEQ ID NO: 4656 - protein, 9 aa, Homo sapiens
ALLRVTPFI

SEQ ID NO: 4657 - protein, 9 aa, Homo sapiens
ALLSALQAL

SEQ ID NO: 4658 - protein, 9 aa, Homo sapiens
ALLSAVTRL

SEQ ID NO: 4659 - protein, 9 aa, Homo sapiens
ALLSHAPRL

SEQ ID NO: 4660 - protein, 9 aa, Homo sapiens
ALLSIIATV

SEQ ID NO: 4661 - protein, 10 aa, Homo sapiens
ALLSLDPAAV

SEQ ID NO: 4662 - protein, 9 aa, Homo sapiens
ALLSQTSPL

SEQ ID NO: 4663 - protein, 9 aa, Homo sapiens
ALLSSLARC

SEQ ID NO: 4664 - protein, 9 aa, Homo sapiens
ALLTRVQEI

SEQ ID NO: 4665 - protein, 11 aa, Homo sapiens
ALLTTIEEMHL

SEQ ID NO: 4666 - protein, 9 aa, Homo sapiens
ALLTYLEQV

SEQ ID NO: 4667 - protein, 9 aa, Homo sapiens
ALLVRLQEV

SEQ ID NO: 4668 - protein, 9 aa, Homo sapiens
ALMAQEQKL

SEQ ID NO: 4669 - protein, 9 aa, Homo sapiens
ALMDHGVKV

SEQ ID NO: 4670 - protein, 10 aa, Homo sapiens
ALMDSNLPRL

SEQ ID NO: 4671 - protein, 9 aa, Homo sapiens
ALMDSSSSL

SEQ ID NO: 4672 - protein, 9 aa, Homo sapiens
ALMEALVLI

SEQ ID NO: 4673 - protein, 9 aa, Homo sapiens
ALMEAVSHV

SEQ ID NO: 4674 - protein, 10 aa, Homo sapiens
ALMEDAEIRL

SEQ ID NO: 4675 - protein, 9 aa, Homo sapiens
ALMEEILKL

SEQ ID NO: 4676 - protein, 10 aa, Homo sapiens
ALMEGQMAQL

SEQ ID NO: 4677 - protein, 11 aa, Homo sapiens
ALMEQIAHQAV

SEQ ID NO: 4678 - protein, 9 aa, Homo sapiens
ALMERMQQL

SEQ ID NO: 4679 - protein, 9 aa, Homo sapiens
ALMERNSEL

SEQ ID NO: 4680 - protein, 11 aa, Homo sapiens
ALMERTGYSMV

SEQ ID NO: 4681 - protein, 10 aa, Homo sapiens
ALMEVKMKEM

SEQ ID NO: 4682 - protein, 9 aa, Homo sapiens
ALMGSPQLV

SEQ ID NO: 4683 - protein, 9 aa, Homo sapiens
ALMHALTDL

SEQ ID NO: 4684 - protein, 9 aa, Homo sapiens
ALMKEIPAL

SEQ ID NO: 4685 - protein, 9 aa, Homo sapiens
ALMPKQATV

SEQ ID NO: 4686 - protein, 9 aa, Homo sapiens
ALMPQLVQL

SEQ ID NO: 4687 - protein, 9 aa, Homo sapiens
ALMPVTPQA

SEQ ID NO: 4688 - protein, 9 aa, Homo sapiens
ALMPWRYAL

SEQ ID NO: 4689 - protein, 9 aa, Homo sapiens
ALMSKLDGI

SEQ ID NO: 4690 - protein, 11 aa, Homo sapiens
ALMYESEKVGV

SEQ ID NO: 4691 - protein, 9 aa, Homo sapiens
ALMYHTITL

SEQ ID NO: 4692 - protein, 9 aa, Homo sapiens
ALNENINQV

SEQ ID NO: 4693 - protein, 9 aa, Homo sapiens
ALNLYMHQV

SEQ ID NO: 4694 - protein, 9 aa, Homo sapiens
ALNQETTYV

SEQ ID NO: 4695 - protein, 9 aa, Homo sapiens
ALNQYYVHL

SEQ ID NO: 4696 - protein, 10 aa, Homo sapiens
ALPDQGIAKA

SEQ ID NO: 4697 - protein, 9 aa, Homo sapiens
ALPEPSPAA

SEQ ID NO: 4698 - protein, 11 aa, Homo sapiens
ALPETTFPALA

SEQ ID NO: 4699 - protein, 10 aa, Homo sapiens
ALPKEDPTAV

SEQ ID NO: 4700 - protein, 8 aa, Homo sapiens
ALPSLPPL

SEQ ID NO: 4701 - protein, 9 aa, Homo sapiens
ALQAEIHRL

SEQ ID NO: 4702 - protein, 9 aa, Homo sapiens
ALQEALENA

SEQ ID NO: 4703 - protein, 10 aa, Homo sapiens
ALQEASEAYL

SEQ ID NO: 4704 - protein, 11 aa, Homo sapiens
ALQEASEAYLV

SEQ ID NO: 4705 - protein, 9 aa, Homo sapiens
ALQEENVKL

SEQ ID NO: 4706 - protein, 9 aa, Homo sapiens
ALQEEQARL

SEQ ID NO: 4707 - protein, 9 aa, Homo sapiens
ALQEKLEEC

SEQ ID NO: 4708 - protein, 9 aa, Homo sapiens
ALQEKLQYL

SEQ ID NO: 4709 - protein, 9 aa, Homo sapiens
ALQERLDGL

SEQ ID NO: 4710 - protein, 9 aa, Homo sapiens
ALQERLDNV

SEQ ID NO: 4711 - protein, 9 aa, Homo sapiens
ALQESLVQI

SEQ ID NO: 4712 - protein, 9 aa, Homo sapiens
ALQETPPQV

SEQ ID NO: 4713 - protein, 9 aa, Homo sapiens
ALQETPTSV

SEQ ID NO: 4714 - protein, 8 aa, Homo sapiens
ALQGLVTE

SEQ ID NO: 4715 - protein, 8 aa, Homo sapiens
ALQLVVLL

SEQ ID NO: 4716 - protein, 9 aa, Homo sapiens
ALQNLEQLL

SEQ ID NO: 4717 - protein, 9 aa, Homo sapiens
ALQPEPIKV

SEQ ID NO: 4718 - protein, 8 aa, Homo sapiens
ALQPPPAP

SEQ ID NO: 4719 - protein, 9 aa, Homo sapiens
ALQQQLQAV

SEQ ID NO: 4720 - protein, 11 aa, Homo sapiens
ALQSGNSQESV

SEQ ID NO: 4721 - protein, 8 aa, Homo sapiens
ALQSQLSI

SEQ ID NO: 4722 - protein, 9 aa, Homo sapiens
ALQTDPAAV

SEQ ID NO: 4723 - protein, 9 aa, Homo sapiens
ALQWVVVEV

SEQ ID NO: 4724 - protein, 10 aa, Homo sapiens
ALRASRAPML

SEQ ID NO: 4725 - protein, 9 aa, Homo sapiens
ALREASELL

SEQ ID NO: 4726 - protein, 9 aa, Homo sapiens
ALRETVVEV

SEQ ID NO: 4727 - protein, 9 aa, Homo sapiens
ALRQQLEEV

SEQ ID NO: 4728 - protein, 10 aa, Artificial Sequence
  unknown
ALSALAVNEI

SEQ ID NO: 4729 - protein, 9 aa, Homo sapiens
ALSALTARL

SEQ ID NO: 4730 - protein, 9 aa, Homo sapiens
ALSASLARV

SEQ ID NO: 4731 - protein, 9 aa, Homo sapiens
ALSDGVHKI

SEQ ID NO: 4732 - protein, 10 aa, Homo sapiens
ALSDLALHFL

SEQ ID NO: 4733 - protein, 9 aa, Homo sapiens
ALSEKIVSV

SEQ ID NO: 4734 - protein, 9 aa, Homo sapiens
ALSELATAV

SEQ ID NO: 4735 - protein, 9 aa, Homo sapiens
ALSELIILT

SEQ ID NO: 4736 - protein, 9 aa, Homo sapiens
ALSELLQQV

SEQ ID NO: 4737 - protein, 9 aa, Homo sapiens
ALSEMVEYI

SEQ ID NO: 4738 - protein, 9 aa, Homo sapiens
ALSERAVAV

SEQ ID NO: 4739 - protein, 9 aa, Homo sapiens
ALSGHVSTV

SEQ ID NO: 4740 - protein, 9 aa, Homo sapiens
ALSGLAVRL

SEQ ID NO: 4741 - protein, 9 aa, Homo sapiens
ALSIQNYHL

SEQ ID NO: 4742 - protein, 9 aa, Homo sapiens
ALSNHLNAV

SEQ ID NO: 4743 - protein, 9 aa, Homo sapiens
ALSPINIQL

SEQ ID NO: 4744 - protein, 9 aa, Homo sapiens
ALSPTVFAL

SEQ ID NO: 4745 - protein, 9 aa, Homo sapiens
ALSPVIPLI

SEQ ID NO: 4746 - protein, 9 aa, Homo sapiens
ALSPVPSHW

SEQ ID NO: 4747 - protein, 9 aa, Homo sapiens
ALSQFHAAV

SEQ ID NO: 4748 - protein, 9 aa, Homo sapiens
ALSRVSVNV

SEQ ID NO: 4749 - protein, 9 aa, Homo sapiens
ALTAVSSQL

SEQ ID NO: 4750 - protein, 9 aa, Homo sapiens
ALTGYLHTI

SEQ ID NO: 4751 - protein, 9 aa, Homo sapiens
ALTRALALA

SEQ ID NO: 4752 - protein, 9 aa, Homo sapiens
ALTRELAII

SEQ ID NO: 4753 - protein, 9 aa, Homo sapiens
ALTSLLKTV

SEQ ID NO: 4754 - protein, 9 aa, Homo sapiens
ALVAIFTHL

SEQ ID NO: 4755 - protein, 11 aa, Homo sapiens
ALVAVPLGMTV

SEQ ID NO: 4756 - protein, 9 aa, Homo sapiens
ALVDGYFRL

SEQ ID NO: 4757 - protein, 9 aa, Homo sapiens
ALVEALAAA

SEQ ID NO: 4758 - protein, 9 aa, Homo sapiens
ALVESLITV

SEQ ID NO: 4759 - protein, 9 aa, Homo sapiens
ALVFELHYV

SEQ ID NO: 4760 - protein, 9 aa, Homo sapiens
ALVGVVKEA

SEQ ID NO: 4761 - protein, 9 aa, Homo sapiens
ALVHHSFAL

SEQ ID NO: 4762 - protein, 9 aa, Homo sapiens
ALVLLLTEV

SEQ ID NO: 4763 - protein, 9 aa, Homo sapiens
ALVNAIVLV

SEQ ID NO: 4764 - protein, 9 aa, Homo sapiens
ALVNELYSL

SEQ ID NO: 4765 - protein, 8 aa, Homo sapiens
ALVNIIAV

SEQ ID NO: 4766 - protein, 11 aa, Homo sapiens
ALVPGYNGTSN

SEQ ID NO: 4767 - protein, 9 aa, Artificial Sequence
  unknown
ALVSAALLL

SEQ ID NO: 4768 - protein, 10 aa, Homo sapiens
ALVSGGVAQA

SEQ ID NO: 4769 - protein, 10 aa, Homo sapiens
ALVSLILNNV

SEQ ID NO: 4770 - protein, 9 aa, Homo sapiens
ALVSYLIRL

SEQ ID NO: 4771 - protein, 9 aa, Homo sapiens
ALWEKWLSL

SEQ ID NO: 4772 - protein, 11 aa, Homo sapiens
ALWENPESGEL

SEQ ID NO: 4773 - protein, 9 aa, Homo sapiens
ALWETEVYI

SEQ ID NO: 4774 - protein, 9 aa, Homo sapiens
ALWFRADEL

SEQ ID NO: 4775 - protein, 9 aa, Homo sapiens
ALWGHLKEL

SEQ ID NO: 4776 - protein, 9 aa, Homo sapiens
ALWKGVQSL

SEQ ID NO: 4777 - protein, 9 aa, Homo sapiens
ALWKQLLEL

SEQ ID NO: 4778 - protein, 9 aa, Homo sapiens
ALWLHVNQL

SEQ ID NO: 4779 - protein, 9 aa, Homo sapiens
ALWREVASL

SEQ ID NO: 4780 - protein, 9 aa, Homo sapiens
ALWTEKLQV

SEQ ID NO: 4781 - protein, 9 aa, Homo sapiens
ALWTGMHTI

SEQ ID NO: 4782 - protein, 9 aa, Homo sapiens
ALYDNVPEC

SEQ ID NO: 4783 - protein, 10 aa, Homo sapiens
ALYDVRTILL

SEQ ID NO: 4784 - protein, 9 aa, Homo sapiens
ALYEGYATV

SEQ ID NO: 4785 - protein, 10 aa, Homo sapiens
ALYEKDNTYL

SEQ ID NO: 4786 - protein, 10 aa, Homo sapiens
ALYERKLLSL

SEQ ID NO: 4787 - protein, 9 aa, Homo sapiens
ALYHEQLAL

SEQ ID NO: 4788 - protein, 11 aa, Homo sapiens
ALYLGAKAIQL

SEQ ID NO: 4789 - protein, 9 aa, Homo sapiens
ALYLYDVEV

SEQ ID NO: 4790 - protein, 11 aa, Homo sapiens
ALYNVDAGHRA

SEQ ID NO: 4791 - protein, 10 aa, Homo sapiens
ALYPGQLVQL

SEQ ID NO: 4792 - protein, 10 aa, Homo sapiens
ALYPHLPPEA

SEQ ID NO: 4793 - protein, 9 aa, Homo sapiens
ALYQFSNLL

SEQ ID NO: 4794 - protein, 9 aa, Homo sapiens
ALYQSLPTL

SEQ ID NO: 4795 - protein, 9 aa, Homo sapiens
ALYTGDPNL

SEQ ID NO: 4796 - protein, 9 aa, Homo sapiens
ALYTVIETV

SEQ ID NO: 4797 - protein, 9 aa, Homo sapiens
ALYVAVVNV

SEQ ID NO: 4798 - protein, 9 aa, Homo sapiens
AMAARPHSI

SEQ ID NO: 4799 - protein, 10 aa, Homo sapiens
AMAHVAGFTV

SEQ ID NO: 4800 - protein, 10 aa, Homo sapiens
AMAQVIGDRV

SEQ ID NO: 4801 - protein, 10 aa, Homo sapiens
AMELCLALLL

SEQ ID NO: 4802 - protein, 9 aa, Homo sapiens
AMFENFVSV

SEQ ID NO: 4803 - protein, 9 aa, Homo sapiens
AMGIAPPKV

SEQ ID NO: 4804 - protein, 9 aa, Homo sapiens
AMIDQVLEL

SEQ ID NO: 4805 - protein, 10 aa, Homo sapiens
AMIEGEIESL

SEQ ID NO: 4806 - protein, 9 aa, Homo sapiens
AMIELVERL

SEQ ID NO: 4807 - protein, 9 aa, Homo sapiens
AMLEKNYKL

SEQ ID NO: 4808 - protein, 9 aa, Homo sapiens
AMLNEPWAV

SEQ ID NO: 4809 - protein, 9 aa, Homo sapiens
AMNDILAQV

SEQ ID NO: 4810 - protein, 9 aa, Homo sapiens
AMQEFLTRL

SEQ ID NO: 4811 - protein, 11 aa, Homo sapiens
AMSNLVPPVEL

SEQ ID NO: 4812 - protein, 9 aa, Toxoplasma gondii GT1
AMTKDNNLL

SEQ ID NO: 4813 - protein, 9 aa, Homo sapiens
AQFGYYFRV

SEQ ID NO: 4814 - protein, 9 aa, Homo sapiens
AQIGADIAL

SEQ ID NO: 4815 - protein, 9 aa, Homo sapiens
AQIGSYVHV

SEQ ID NO: 4816 - protein, 9 aa, Homo sapiens
AQIRYLTQV

SEQ ID NO: 4817 - protein, 9 aa, Homo sapiens
AQLEAEVKL

SEQ ID NO: 4818 - protein, 9 aa, Homo sapiens
AQLISLDQV

SEQ ID NO: 4819 - protein, 9 aa, Homo sapiens
AQNPSLLAL

SEQ ID NO: 4820 - protein, 11 aa, Homo sapiens
ATIEALDAGAV

SEQ ID NO: 4821 - protein, 11 aa, Homo sapiens
AVGPASILKEV

SEQ ID NO: 4822 - protein, 10 aa, Homo sapiens
AVLQGKLAEV

SEQ ID NO: 4823 - protein, 9 aa, Homo sapiens
AVMESIQGV

SEQ ID NO: 4824 - protein, 11 aa, Homo sapiens
AVQAAAAQAAV

SEQ ID NO: 4825 - protein, 9 aa, Homo sapiens
AVWAAVQAV

SEQ ID NO: 4826 - protein, 9 aa, Homo sapiens
CLADELINA

SEQ ID NO: 4827 - protein, 10 aa, Homo sapiens
CLCMAEAILL

SEQ ID NO: 4828 - protein, 10 aa, Homo sapiens
DFDGDEIFHV

SEQ ID NO: 4829 - protein, 9 aa, Homo sapiens
DIETGQQTV

SEQ ID NO: 4830 - protein, 8 aa, Homo sapiens
DLAGLKEL

SEQ ID NO: 4831 - protein, 9 aa, Homo sapiens
DLATLILNM

SEQ ID NO: 4832 - protein, 8 aa, Homo sapiens
DLEHKVLL

SEQ ID NO: 4833 - protein, 8 aa, Homo sapiens
DLEKTRQY

SEQ ID NO: 4834 - protein, 10 aa, Homo sapiens
DLENENMMRV

SEQ ID NO: 4835 - protein, 9 aa, Homo sapiens
DLETERILL

SEQ ID NO: 4836 - protein, 8 aa, Homo sapiens
DLGSKDLK

SEQ ID NO: 4837 - protein, 9 aa, Homo sapiens
DLIHEIYTV

SEQ ID NO: 4838 - protein, 8 aa, Homo sapiens
DLKPTLTI

SEQ ID NO: 4839 - protein, 8 aa, Homo sapiens
DLLLRLEP

SEQ ID NO: 4840 - protein, 10 aa, Homo sapiens
DLMTLHPIEI

SEQ ID NO: 4841 - protein, 10 aa, Homo sapiens
DLNWLVKNSY

SEQ ID NO: 4842 - protein, 8 aa, Homo sapiens
DLPLGVKL

SEQ ID NO: 4843 - protein, 11 aa, Homo sapiens
DLQATALDLEW

SEQ ID NO: 4844 - protein, 8 aa, Homo sapiens
DLRLLSSL

SEQ ID NO: 4845 - protein, 11 aa, Homo sapiens
DLSDNTGKMEV

SEQ ID NO: 4846 - protein, 9 aa, Homo sapiens
DLSPEVPSN

SEQ ID NO: 4847 - protein, 9 aa, Homo sapiens
DLTLAGRVI

SEQ ID NO: 4848 - protein, 10 aa, Homo sapiens
DLTLAGRVIV

SEQ ID NO: 4849 - protein, 9 aa, Homo sapiens
DLVLQTLPL

SEQ ID NO: 4850 - protein, 9 aa, Homo sapiens
ELAEELLRI

SEQ ID NO: 4851 - protein, 9 aa, Homo sapiens
ELAKELPQV

SEQ ID NO: 4852 - protein, 11 aa, Homo sapiens
ELANKVGAAEI

SEQ ID NO: 4853 - protein, 8 aa, Homo sapiens
ELANLEKW

SEQ ID NO: 4854 - protein, 9 aa, Homo sapiens
ELAQLESIL

SEQ ID NO: 4855 - protein, 9 aa, Homo sapiens
ELDPEHQRA

SEQ ID NO: 4856 - protein, 9 aa, Homo sapiens
ELEARLDAA

SEQ ID NO: 4857 - protein, 10 aa, Homo sapiens
ELEEIARRVQ

SEQ ID NO: 4858 - protein, 9 aa, Homo sapiens
ELERESEFW

SEQ ID NO: 4859 - protein, 9 aa, Homo sapiens
ELETLLAKL

SEQ ID NO: 4860 - protein, 11 aa, Homo sapiens
ELFPTPALLQV

SEQ ID NO: 4861 - protein, 9 aa, Homo sapiens
ELFSSPPAV

SEQ ID NO: 4862 - protein, 10 aa, Homo sapiens
ELGLGRVVEN

SEQ ID NO: 4863 - protein, 9 aa, Homo sapiens
ELISKAIEI

SEQ ID NO: 4864 - protein, 9 aa, Homo sapiens
ELIVCSHEI

SEQ ID NO: 4865 - protein, 9 aa, Homo sapiens
ELKDLLKKN

SEQ ID NO: 4866 - protein, 8 aa, Homo sapiens
ELKIEEYV

SEQ ID NO: 4867 - protein, 10 aa, Homo sapiens
ELKKENQQII

SEQ ID NO: 4868 - protein, 8 aa, Homo sapiens
ELKKINQN

SEQ ID NO: 4869 - protein, 9 aa, Homo sapiens
ELKLQLQEL

SEQ ID NO: 4870 - protein, 10 aa, Homo sapiens
ELLGAGIEKV

SEQ ID NO: 4871 - protein, 9 aa, Homo sapiens
ELLKILQEL

SEQ ID NO: 4872 - protein, 9 aa, Homo sapiens
ELLLLQPEL

SEQ ID NO: 4873 - protein, 9 aa, Homo sapiens
ELMEQVPHI

SEQ ID NO: 4874 - protein, 10 aa, Homo sapiens
ELMMVIAQEN

SEQ ID NO: 4875 - protein, 9 aa, Homo sapiens
ELNILSLDI

SEQ ID NO: 4876 - protein, 9 aa, Homo sapiens
ELNISSLQI

SEQ ID NO: 4877 - protein, 9 aa, Homo sapiens
ELNLRSNEL

SEQ ID NO: 4878 - protein, 11 aa, Homo sapiens
ELQALYALQAL

SEQ ID NO: 4879 - protein, 9 aa, Homo sapiens
ELQAVLSYI

SEQ ID NO: 4880 - protein, 11 aa, Homo sapiens
ELQDCALPLLK

SEQ ID NO: 4881 - protein, 9 aa, Homo sapiens
ELQKKIQEL

SEQ ID NO: 4882 - protein, 8 aa, Homo sapiens
ELQLLEKV

SEQ ID NO: 4883 - protein, 11 aa, Homo sapiens
ELRKGDQILSV

SEQ ID NO: 4884 - protein, 9 aa, Homo sapiens
ELSYHNLEL

SEQ ID NO: 4885 - protein, 9 aa, Homo sapiens
ELTDKLLIF

SEQ ID NO: 4886 - protein, 10 aa, Homo sapiens
ELTLELADIL

SEQ ID NO: 4887 - protein, 10 aa, Homo sapiens
ELVGGNQVKN

SEQ ID NO: 4888 - protein, 10 aa, Homo sapiens
ELVLSGTRAL

SEQ ID NO: 4889 - protein, 9 aa, Homo sapiens
ELVVSIVLL

SEQ ID NO: 4890 - protein, 9 aa, Homo sapiens
ELYLDCIQV

SEQ ID NO: 4891 - protein, 9 aa, Homo sapiens
FAAPMDITL

SEQ ID NO: 4892 - protein, 9 aa, Homo sapiens
FAIPLIEKL

SEQ ID NO: 4893 - protein, 9 aa, Homo sapiens
FIDDANYSV

SEQ ID NO: 4894 - protein, 9 aa, Homo sapiens
FIDEYVETV

SEQ ID NO: 4895 - protein, 9 aa, Homo sapiens
FIFEKILQL

SEQ ID NO: 4896 - protein, 9 aa, Homo sapiens
FILEKIEYL

SEQ ID NO: 4897 - protein, 9 aa, Homo sapiens
FILPHISTA

SEQ ID NO: 4898 - protein, 9 aa, Homo sapiens
FILPYIHKA

SEQ ID NO: 4899 - protein, 9 aa, Homo sapiens
FINSRIITV

SEQ ID NO: 4900 - protein, 9 aa, Homo sapiens
FIREHIEEL

SEQ ID NO: 4901 - protein, 9 aa, Homo sapiens
FIWDFIEKV

SEQ ID NO: 4902 - protein, 11 aa, Homo sapiens
FLAAFTLPALL

SEQ ID NO: 4903 - protein, 9 aa, Homo sapiens
FLADDLGGL

SEQ ID NO: 4904 - protein, 11 aa, Homo sapiens
FLADPVSNMAM

SEQ ID NO: 4905 - protein, 10 aa, Homo sapiens
FLAEEKHLHV

SEQ ID NO: 4906 - protein, 11 aa, Homo sapiens
FLAEEKHLHVL

SEQ ID NO: 4907 - protein, 9 aa, Homo sapiens
FLAENDWEM

SEQ ID NO: 4908 - protein, 10 aa, Homo sapiens
FLAERLYAEV

SEQ ID NO: 4909 - protein, 9 aa, Homo sapiens
FLAFILHRL

SEQ ID NO: 4910 - protein, 9 aa, Homo sapiens
FLAGEGMTV

SEQ ID NO: 4911 - protein, 9 aa, Homo sapiens
FLAHIYTEL

SEQ ID NO: 4912 - protein, 9 aa, Homo sapiens
FLAKDFNFL

SEQ ID NO: 4913 - protein, 11 aa, Homo sapiens
FLAKDFNFLTL

SEQ ID NO: 4914 - protein, 9 aa, Homo sapiens
FLANLHITA

SEQ ID NO: 4915 - protein, 10 aa, Homo sapiens
FLAPASKMII

SEQ ID NO: 4916 - protein, 9 aa, Homo sapiens
FLAQRAVEL

SEQ ID NO: 4917 - protein, 10 aa, Homo sapiens
FLASVVDPRV

SEQ ID NO: 4918 - protein, 9 aa, Homo sapiens
FLDEEVKLI

SEQ ID NO: 4919 - protein, 10 aa, Homo sapiens
FLDEKTHELL

SEQ ID NO: 4920 - protein, 11 aa, Homo sapiens
FLDEQAEKHNI

SEQ ID NO: 4921 - protein, 8 aa, Homo sapiens
FLDESRST

SEQ ID NO: 4922 - protein, 9 aa, Homo sapiens
FLDEYIFLA

SEQ ID NO: 4923 - protein, 10 aa, Homo sapiens
FLDFIGHILT

SEQ ID NO: 4924 - protein, 10 aa, Homo sapiens
FLDGNELTLA

SEQ ID NO: 4925 - protein, 9 aa, Homo sapiens
FLDIILKTV

SEQ ID NO: 4926 - protein, 9 aa, Homo sapiens
FLDKELKEC

SEQ ID NO: 4927 - protein, 9 aa, Homo sapiens
FLDKFKQVF

SEQ ID NO: 4928 - protein, 9 aa, Homo sapiens
FLDKILVKL

SEQ ID NO: 4929 - protein, 9 aa, Homo sapiens
FLDMTNWNL

SEQ ID NO: 4930 - protein, 9 aa, Homo sapiens
FLDNAIMIV

SEQ ID NO: 4931 - protein, 9 aa, Homo sapiens
FLDNGPKTI

SEQ ID NO: 4932 - protein, 9 aa, Homo sapiens
FLDNSFEKV

SEQ ID NO: 4933 - protein, 9 aa, Homo sapiens
FLDNSLDTV

SEQ ID NO: 4934 - protein, 11 aa, Homo sapiens
FLDPHTTQTFV

SEQ ID NO: 4935 - protein, 10 aa, Homo sapiens
FLDPKELMEL

SEQ ID NO: 4936 - protein, 9 aa, Homo sapiens
FLDQVAHKL

SEQ ID NO: 4937 - protein, 9 aa, Homo sapiens
FLDSAYFRL

SEQ ID NO: 4938 - protein, 9 aa, Homo sapiens
FLDSEVSEL

SEQ ID NO: 4939 - protein, 9 aa, Homo sapiens
FLDSKFYLL

SEQ ID NO: 4940 - protein, 9 aa, Homo sapiens
FLDTSNQHL

SEQ ID NO: 4941 - protein, 9 aa, Homo sapiens
FLDVFLPRV

SEQ ID NO: 4942 - protein, 9 aa, Homo sapiens
FLENETWEL

SEQ ID NO: 4943 - protein, 9 aa, Homo sapiens
FLETNVPLL

SEQ ID NO: 4944 - protein, 10 aa, Homo sapiens
FLFASTILHL

SEQ ID NO: 4945 - protein, 9 aa, Homo sapiens
FLFDKTLLI

SEQ ID NO: 4946 - protein, 10 aa, Homo sapiens
FLFDPKKLSV

SEQ ID NO: 4947 - protein, 10 aa, Homo sapiens
FLFDTKPLIV

SEQ ID NO: 4948 - protein, 9 aa, Homo sapiens
FLFELPSRL

SEQ ID NO: 4949 - protein, 10 aa, Homo sapiens
FLFEYDTPRM

SEQ ID NO: 4950 - protein, 10 aa, Homo sapiens
FLFGEEPSKL

SEQ ID NO: 4951 - protein, 11 aa, Homo sapiens
FLFGGLAGMGA

SEQ ID NO: 4952 - protein, 9 aa, Homo sapiens
FLFLDRTYV

SEQ ID NO: 4953 - protein, 11 aa, Homo sapiens
FLFNTENKLLL

SEQ ID NO: 4954 - protein, 9 aa, Homo sapiens
FLFNYDYTL

SEQ ID NO: 4955 - protein, 9 aa, Homo sapiens
FLFPHSVLV

SEQ ID NO: 4956 - protein, 9 aa, Homo sapiens
FLFSKFIEL

SEQ ID NO: 4957 - protein, 8 aa, Homo sapiens
FLGIVAEV

SEQ ID NO: 4958 - protein, 8 aa, Homo sapiens
FLGKIYQI

SEQ ID NO: 4959 - protein, 9 aa, Homo sapiens
FLGTFILKV

SEQ ID NO: 4960 - protein, 11 aa, Homo sapiens
FLGVEMEKVQL

SEQ ID NO: 4961 - protein, 9 aa, Homo sapiens
FLHDNMVEI

SEQ ID NO: 4962 - protein, 11 aa, Homo sapiens
FLHEESILERV

SEQ ID NO: 4963 - protein, 9 aa, Homo sapiens
FLHLKEFYL

SEQ ID NO: 4964 - protein, 10 aa, Homo sapiens
FLHWYTGEGM

SEQ ID NO: 4965 - protein, 9 aa, Homo sapiens
FLIAEKVSL

SEQ ID NO: 4966 - protein, 11 aa, Homo sapiens
FLIAQLPKLQY

SEQ ID NO: 4967 - protein, 9 aa, Homo sapiens
FLIDRVFGI

SEQ ID NO: 4968 - protein, 10 aa, Homo sapiens
FLIEYGPAQL

SEQ ID NO: 4969 - protein, 11 aa, Homo sapiens
FLIILPKELQA

SEQ ID NO: 4970 - protein, 9 aa, Homo sapiens
FLIIPLHSL

SEQ ID NO: 4971 - protein, 11 aa, Homo sapiens
FLILPDAEAQL

SEQ ID NO: 4972 - protein, 11 aa, Homo sapiens
FLILPDMLKNA

SEQ ID NO: 4973 - protein, 10 aa, Homo sapiens
FLINGKPFYF

SEQ ID NO: 4974 - protein, 10 aa, Homo sapiens
FLIPFETRQL

SEQ ID NO: 4975 - protein, 9 aa, Homo sapiens
FLIQNVLRL

SEQ ID NO: 4976 - protein, 9 aa, Homo sapiens
FLISRLIKL

SEQ ID NO: 4977 - protein, 9 aa, Homo sapiens
FLISSHFLL

SEQ ID NO: 4978 - protein, 9 aa, Homo sapiens
FLITILDHL

SEQ ID NO: 4979 - protein, 9 aa, Homo sapiens
FLITSNLEL

SEQ ID NO: 4980 - protein, 9 aa, Homo sapiens
FLKGFLTEV

SEQ ID NO: 4981 - protein, 9 aa, Homo sapiens
FLLDEVDKL

SEQ ID NO: 4982 - protein, 9 aa, Homo sapiens
FLLDFHSHL

SEQ ID NO: 4983 - protein, 9 aa, Homo sapiens
FLLDKPQDL

SEQ ID NO: 4984 - protein, 11 aa, Homo sapiens
FLLDMHWNPSL

SEQ ID NO: 4985 - protein, 10 aa, Homo sapiens
FLLDTADVAL

SEQ ID NO: 4986 - protein, 10 aa, Homo sapiens
FLLEDLSQKL

SEQ ID NO: 4987 - protein, 10 aa, Homo sapiens
FLLEGIRSLV

SEQ ID NO: 4988 - protein, 9 aa, Homo sapiens
FLLEHIRIL

SEQ ID NO: 4989 - protein, 9 aa, Homo sapiens
FLLFINHRL

SEQ ID NO: 4990 - protein, 9 aa, Homo sapiens
FLLGEHLLL

SEQ ID NO: 4991 - protein, 10 aa, Homo sapiens
FLLGFIPAKA

SEQ ID NO: 4992 - protein, 10 aa, Homo sapiens
FLLGSWLEQA

SEQ ID NO: 4993 - protein, 9 aa, Homo sapiens
FLLHVQQQI

SEQ ID NO: 4994 - protein, 9 aa, Homo sapiens
FLLKDLSSL

SEQ ID NO: 4995 - protein, 9 aa, Homo sapiens
FLLKQIEFL

SEQ ID NO: 4996 - protein, 9 aa, Homo sapiens
FLLLQSIKL

SEQ ID NO: 4997 - protein, 11 aa, Homo sapiens
FLLNQADEVKL

SEQ ID NO: 4998 - protein, 10 aa, Homo sapiens
FLLPDGLVRL

SEQ ID NO: 4999 - protein, 9 aa, Homo sapiens
FLLPEVGRG

SEQ ID NO: 5000 - protein, 9 aa, Homo sapiens
FLLPHLKDI

SEQ ID NO: 5001 - protein, 10 aa, Homo sapiens
FLLPLLIEKV

SEQ ID NO: 5002 - protein, 9 aa, Homo sapiens
FLLPMFERL

SEQ ID NO: 5003 - protein, 9 aa, Homo sapiens
FLLPVIMRA

SEQ ID NO: 5004 - protein, 9 aa, Homo sapiens
FLLQLQEEL

SEQ ID NO: 5005 - protein, 9 aa, Homo sapiens
FLLQRVHSL

SEQ ID NO: 5006 - protein, 10 aa, Artificial Sequence
  unknown
FLLSIGMLFL

SEQ ID NO: 5007 - protein, 10 aa, Homo sapiens
FLLSLRGAGA

SEQ ID NO: 5008 - protein, 10 aa, Homo sapiens
FLLTPVPLRS

SEQ ID NO: 5009 - protein, 9 aa, Homo sapiens
FLMEMGFRM

SEQ ID NO: 5010 - protein, 11 aa, Homo sapiens
FLMENGSITSI

SEQ ID NO: 5011 - protein, 9 aa, Homo sapiens
FLMKQQSLL

SEQ ID NO: 5012 - protein, 11 aa, Homo sapiens
FLMRVMDIPYL

SEQ ID NO: 5013 - protein, 9 aa, Homo sapiens
FLMSLLLKN

SEQ ID NO: 5014 - protein, 9 aa, Homo sapiens
FLNDIFERI

SEQ ID NO: 5015 - protein, 9 aa, Homo sapiens
FLNEDLNQL

SEQ ID NO: 5016 - protein, 11 aa, Homo sapiens
FLNEDLNQLIK

SEQ ID NO: 5017 - protein, 9 aa, Homo sapiens
FLNEEVKSL

SEQ ID NO: 5018 - protein, 9 aa, Homo sapiens
FLNEHLQEA

SEQ ID NO: 5019 - protein, 9 aa, Homo sapiens
FLNEIQQSI

SEQ ID NO: 5020 - protein, 9 aa, Homo sapiens
FLNKLVILV

SEQ ID NO: 5021 - protein, 9 aa, Homo sapiens
FLNKNQELL

SEQ ID NO: 5022 - protein, 9 aa, Homo sapiens
FLNLFNHTL

SEQ ID NO: 5023 - protein, 9 aa, Homo sapiens
FLNQFHFGV

SEQ ID NO: 5024 - protein, 9 aa, Homo sapiens
FLNQVLAEI

SEQ ID NO: 5025 - protein, 9 aa, Homo sapiens
FLNSEIHQV

SEQ ID NO: 5026 - protein, 9 aa, Homo sapiens
FLPFLTTEV

SEQ ID NO: 5027 - protein, 9 aa, Homo sapiens
FLPHELPLL

SEQ ID NO: 5028 - protein, 9 aa, Homo sapiens
FLPLLLVLL

SEQ ID NO: 5029 - protein, 10 aa, Homo sapiens
FLQDLKELKV

SEQ ID NO: 5030 - protein, 9 aa, Homo sapiens
FLQDLSLEL

SEQ ID NO: 5031 - protein, 9 aa, Homo sapiens
FLQEATLYL

SEQ ID NO: 5032 - protein, 10 aa, Homo sapiens
FLQEEPGQLL

SEQ ID NO: 5033 - protein, 10 aa, Homo sapiens
FLQEKSPAVA

SEQ ID NO: 5034 - protein, 9 aa, Homo sapiens
FLQEQLVEL

SEQ ID NO: 5035 - protein, 9 aa, Homo sapiens
FLQEWEVYA

SEQ ID NO: 5036 - protein, 9 aa, Homo sapiens
FLQEYVANL

SEQ ID NO: 5037 - protein, 9 aa, Homo sapiens
FLQGQNFFL

SEQ ID NO: 5038 - protein, 11 aa, Homo sapiens
FLQKSIEDMTV

SEQ ID NO: 5039 - protein, 10 aa, Homo sapiens
FLQPGGYHVL

SEQ ID NO: 5040 - protein, 11 aa, Homo sapiens
FLQVTSPEENI

SEQ ID NO: 5041 - protein, 9 aa, Homo sapiens
FLREGSEFL

SEQ ID NO: 5042 - protein, 9 aa, Homo sapiens
FLRNINEYL

SEQ ID NO: 5043 - protein, 9 aa, Homo sapiens
FLSDAIPGL

SEQ ID NO: 5044 - protein, 9 aa, Homo sapiens
FLSELQYYL

SEQ ID NO: 5045 - protein, 9 aa, Homo sapiens
FLSEVFAQL

SEQ ID NO: 5046 - protein, 9 aa, Homo sapiens
FLSFMNTEL

SEQ ID NO: 5047 - protein, 9 aa, Homo sapiens
FLSGAKIWL

SEQ ID NO: 5048 - protein, 10 aa, Homo sapiens
FLSHLSTLEI

SEQ ID NO: 5049 - protein, 9 aa, Homo sapiens
FLSNDTVQL

SEQ ID NO: 5050 - protein, 9 aa, Homo sapiens
FLSNIFQAL

SEQ ID NO: 5051 - protein, 9 aa, Homo sapiens
FLSNVLQEL

SEQ ID NO: 5052 - protein, 9 aa, Homo sapiens
FLSPWPPAV

SEQ ID NO: 5053 - protein, 9 aa, Homo sapiens
FLSQSIHLL

SEQ ID NO: 5054 - protein, 9 aa, Homo sapiens
FLSSKVLEL

SEQ ID NO: 5055 - protein, 9 aa, Homo sapiens
FLSTLEHHL

SEQ ID NO: 5056 - protein, 9 aa, Homo sapiens
FLTAVAHRL

SEQ ID NO: 5057 - protein, 10 aa, Homo sapiens
FLTDLEDLTL

SEQ ID NO: 5058 - protein, 9 aa, Homo sapiens
FLTEHNSNV

SEQ ID NO: 5059 - protein, 9 aa, Homo sapiens
FLTEINSTV

SEQ ID NO: 5060 - protein, 9 aa, Homo sapiens
FLTELAERV

SEQ ID NO: 5061 - protein, 9 aa, Homo sapiens
FLTELTRLF

SEQ ID NO: 5062 - protein, 9 aa, Homo sapiens
FLTEMVHFI

SEQ ID NO: 5063 - protein, 9 aa, Homo sapiens
FLTFPIYKV

SEQ ID NO: 5064 - protein, 8 aa, Homo sapiens
FLTGTLQN

SEQ ID NO: 5065 - protein, 9 aa, Homo sapiens
FLTRIISQL

SEQ ID NO: 5066 - protein, 9 aa, Homo sapiens
FLTRLQVHL

SEQ ID NO: 5067 - protein, 9 aa, Homo sapiens
FLTSVVELI

SEQ ID NO: 5068 - protein, 9 aa, Homo sapiens
FLVDIMEHL

SEQ ID NO: 5069 - protein, 9 aa, Homo sapiens
FLVDMTMHL

SEQ ID NO: 5070 - protein, 10 aa, Homo sapiens
FLVEGLFMRV

SEQ ID NO: 5071 - protein, 10 aa, Homo sapiens
FLVEKQPPQV

SEQ ID NO: 5072 - protein, 11 aa, Homo sapiens
FLVEPQEDTRL

SEQ ID NO: 5073 - protein, 9 aa, Homo sapiens
FLVERLLHI

SEQ ID NO: 5074 - protein, 11 aa, Homo sapiens
FLVPIESIERA

SEQ ID NO: 5075 - protein, 9 aa, Homo sapiens
FLVQAKTYL

SEQ ID NO: 5076 - protein, 9 aa, Homo sapiens
FLWAYAAQL

SEQ ID NO: 5077 - protein, 11 aa, Homo sapiens
FLWDAAAGMEL

SEQ ID NO: 5078 - protein, 10 aa, Homo sapiens
FLWDGEDSSF

SEQ ID NO: 5079 - protein, 9 aa, Homo sapiens
FLWEAESHA

SEQ ID NO: 5080 - protein, 10 aa, Homo sapiens
FLWEEKFNSL

SEQ ID NO: 5081 - protein, 10 aa, Homo sapiens
FLWEYGDLHL

SEQ ID NO: 5082 - protein, 9 aa, Homo sapiens
FLWKEPATM

SEQ ID NO: 5083 - protein, 9 aa, Homo sapiens
FLWNVFQRV

SEQ ID NO: 5084 - protein, 10 aa, Homo sapiens
FLWVGATPHL

SEQ ID NO: 5085 - protein, 9 aa, Homo sapiens
FLYASGLGV

SEQ ID NO: 5086 - protein, 11 aa, Homo sapiens
FLYDHIQPVRA

SEQ ID NO: 5087 - protein, 9 aa, Homo sapiens
FLYKKLPSV

SEQ ID NO: 5088 - protein, 9 aa, Homo sapiens
FLYLAKVYV

SEQ ID NO: 5089 - protein, 10 aa, Homo sapiens
FLYNLTLQRA

SEQ ID NO: 5090 - protein, 11 aa, Homo sapiens
FLYPAAQLQHL

SEQ ID NO: 5091 - protein, 9 aa, Homo sapiens
FLYPFLSHL

SEQ ID NO: 5092 - protein, 9 aa, Homo sapiens
FLYSETWNI

SEQ ID NO: 5093 - protein, 9 aa, Homo sapiens
FLYSLLMKL

SEQ ID NO: 5094 - protein, 10 aa, Homo sapiens
FLYTGEGDTV

SEQ ID NO: 5095 - protein, 9 aa, Homo sapiens
FMATIAEGL

SEQ ID NO: 5096 - protein, 9 aa, Homo sapiens
FMLKDMLYL

SEQ ID NO: 5097 - protein, 10 aa, Homo sapiens
FMQDPMEVFV

SEQ ID NO: 5098 - protein, 9 aa, Homo sapiens
FMSEYLIEL

SEQ ID NO: 5099 - protein, 9 aa, Homo sapiens
FMTTNVPNV

SEQ ID NO: 5100 - protein, 11 aa, Homo sapiens
FQFVGIENIHV

SEQ ID NO: 5101 - protein, 11 aa, Homo sapiens
FQHEENLLQQV

SEQ ID NO: 5102 - protein, 9 aa, Homo sapiens
FQLPIRFNL

SEQ ID NO: 5103 - protein, 9 aa, Homo sapiens
FQYVHEHYL

SEQ ID NO: 5104 - protein, 10 aa, Homo sapiens
FTFEGKLEAA

SEQ ID NO: 5105 - protein, 9 aa, Homo sapiens
FVIAELVNV

SEQ ID NO: 5106 - protein, 9 aa, Homo sapiens
FVIDLQTRL

SEQ ID NO: 5107 - protein, 11 aa, Homo sapiens
FVMEGVKNLVL

SEQ ID NO: 5108 - protein, 9 aa, Homo sapiens
FVMETFVHL

SEQ ID NO: 5109 - protein, 11 aa, Homo sapiens
FVQEVVQSQQV

SEQ ID NO: 5110 - protein, 9 aa, Homo sapiens
FVSPPPPTA

SEQ ID NO: 5111 - protein, 9 aa, Homo sapiens
FVWEASHYL

SEQ ID NO: 5112 - protein, 9 aa, Homo sapiens
GIQSSAISV

SEQ ID NO: 5113 - protein, 10 aa, Homo sapiens
GISRQGIIAV

SEQ ID NO: 5114 - protein, 9 aa, Homo sapiens
GITGLVLSI

SEQ ID NO: 5115 - protein, 10 aa, Homo sapiens
GLAAFLLQHV

SEQ ID NO: 5116 - protein, 9 aa, Homo sapiens
GLAAKLMEL

SEQ ID NO: 5117 - protein, 9 aa, Homo sapiens
GLAALAVHL

SEQ ID NO: 5118 - protein, 9 aa, Homo sapiens
GLAAQPPAA

SEQ ID NO: 5119 - protein, 9 aa, Homo sapiens
GLAAVFDTV

SEQ ID NO: 5120 - protein, 9 aa, Homo sapiens
GLADITQQL

SEQ ID NO: 5121 - protein, 10 aa, Homo sapiens
GLADLSELQL

SEQ ID NO: 5122 - protein, 10 aa, Homo sapiens
GLADPAPVAV

SEQ ID NO: 5123 - protein, 11 aa, Homo sapiens
GLADPSALTQA

SEQ ID NO: 5124 - protein, 11 aa, Homo sapiens
GLAEDIDKGEV

SEQ ID NO: 5125 - protein, 9 aa, Homo sapiens
GLAEFQENV

SEQ ID NO: 5126 - protein, 10 aa, Homo sapiens
GLAELRHLNL

SEQ ID NO: 5127 - protein, 11 aa, Homo sapiens
GLAGIVGYHTV

SEQ ID NO: 5128 - protein, 9 aa, Homo sapiens
GLAGYVEAL

SEQ ID NO: 5129 - protein, 9 aa, Homo sapiens
GLAKLIADV

SEQ ID NO: 5130 - protein, 11 aa, Homo sapiens
GLAMVEAISYV

SEQ ID NO: 5131 - protein, 9 aa, Homo sapiens
GLAPLHIQL

SEQ ID NO: 5132 - protein, 9 aa, Homo sapiens
GLAPTSPHL

SEQ ID NO: 5133 - protein, 9 aa, Homo sapiens
GLAPTVPQT

SEQ ID NO: 5134 - protein, 9 aa, Homo sapiens
GLAVKEWLL

SEQ ID NO: 5135 - protein, 9 aa, Homo sapiens
GLAVLAVVV

SEQ ID NO: 5136 - protein, 9 aa, Homo sapiens
GLDELFVQV

SEQ ID NO: 5137 - protein, 10 aa, Homo sapiens
GLDIEGVKTV

SEQ ID NO: 5138 - protein, 11 aa, Homo sapiens
GLDNAVSLFQV

SEQ ID NO: 5139 - protein, 9 aa, Homo sapiens
GLDNQIQEI

SEQ ID NO: 5140 - protein, 10 aa, Homo sapiens
GLDPGKQIKL

SEQ ID NO: 5141 - protein, 10 aa, Homo sapiens
GLDPSTPAQV

SEQ ID NO: 5142 - protein, 11 aa, Homo sapiens
GLDPTGTVILL

SEQ ID NO: 5143 - protein, 9 aa, Homo sapiens
GLDSGFHSV

SEQ ID NO: 5144 - protein, 9 aa, Homo sapiens
GLELTRVTV

SEQ ID NO: 5145 - protein, 9 aa, Homo sapiens
GLFAPVHKV

SEQ ID NO: 5146 - protein, 9 aa, Homo sapiens
GLFPTSHSV

SEQ ID NO: 5147 - protein, 9 aa, Homo sapiens
GLFPWTPKL

SEQ ID NO: 5148 - protein, 10 aa, Homo sapiens
GLFSKILDEV

SEQ ID NO: 5149 - protein, 11 aa, Homo sapiens
GLFTLSHITQL

SEQ ID NO: 5150 - protein, 11 aa, Homo sapiens
GLGEGFQTVRV

SEQ ID NO: 5151 - protein, 9 aa, Homo sapiens
GLGIILDSV

SEQ ID NO: 5152 - protein, 8 aa, Homo sapiens
GLGVFVQL

SEQ ID NO: 5153 - protein, 9 aa, Homo sapiens
GLHSYFITV

SEQ ID NO: 5154 - protein, 10 aa, Homo sapiens
GLIDAIKPFL

SEQ ID NO: 5155 - protein, 11 aa, Homo sapiens
GLIDGAVVSGI

SEQ ID NO: 5156 - protein, 11 aa, Homo sapiens
GLIDGVVEADL

SEQ ID NO: 5157 - protein, 10 aa, Homo sapiens
GLIEDYEALL

SEQ ID NO: 5158 - protein, 10 aa, Homo sapiens
GLIEKNIELF

SEQ ID NO: 5159 - protein, 9 aa, Homo sapiens
GLIFVITGV

SEQ ID NO: 5160 - protein, 9 aa, Homo sapiens
GLIKAIMHL

SEQ ID NO: 5161 - protein, 10 aa, Homo sapiens
GLILSQLGDL

SEQ ID NO: 5162 - protein, 11 aa, Homo sapiens
GLIQEINDLRL

SEQ ID NO: 5163 - protein, 10 aa, Homo sapiens
GLIQIELTKA

SEQ ID NO: 5164 - protein, 10 aa, Homo sapiens
GLIQNGDWTF

SEQ ID NO: 5165 - protein, 9 aa, Homo sapiens
GLKIEELTL

SEQ ID NO: 5166 - protein, 9 aa, Homo sapiens
GLLAAFPKL

SEQ ID NO: 5167 - protein, 9 aa, Homo sapiens
GLLAKIFEL

SEQ ID NO: 5168 - protein, 11 aa, Homo sapiens
GLLALGDYMNV

SEQ ID NO: 5169 - protein, 10 aa, Homo sapiens
GLLAPAPAQA

SEQ ID NO: 5170 - protein, 11 aa, Homo sapiens
GLLDLPFRVGV

SEQ ID NO: 5171 - protein, 10 aa, Homo sapiens
GLLDPSVFHV

SEQ ID NO: 5172 - protein, 11 aa, Homo sapiens
GLLDQDTGLVL

SEQ ID NO: 5173 - protein, 10 aa, Homo sapiens
GLLDQHGVRL

SEQ ID NO: 5174 - protein, 9 aa, Homo sapiens
GLLDSPTSI

SEQ ID NO: 5175 - protein, 11 aa, Homo sapiens
GLLEARGILGL

SEQ ID NO: 5176 - protein, 9 aa, Homo sapiens
GLLEKAVLL

SEQ ID NO: 5177 - protein, 9 aa, Homo sapiens
GLLEKLTAI

SEQ ID NO: 5178 - protein, 9 aa, Homo sapiens
GLLENELKL

SEQ ID NO: 5179 - protein, 9 aa, Homo sapiens
GLLERPVLL

SEQ ID NO: 5180 - protein, 9 aa, Homo sapiens
GLLERVKEL

SEQ ID NO: 5181 - protein, 11 aa, Homo sapiens
GLLERVKELQA

SEQ ID NO: 5182 - protein, 11 aa, Homo sapiens
GLLESHGIQKV

SEQ ID NO: 5183 - protein, 11 aa, Homo sapiens
GLLESRLDPYL

SEQ ID NO: 5184 - protein, 8 aa, Homo sapiens
GLLGELIL

SEQ ID NO: 5185 - protein, 9 aa, Homo sapiens
GLLGYLHFV

SEQ ID NO: 5186 - protein, 9 aa, Homo sapiens
GLLHLTLLL

SEQ ID NO: 5187 - protein, 9 aa, Homo sapiens
GLLHVFVRV

SEQ ID NO: 5188 - protein, 11 aa, Homo sapiens
GLLKLPEDALV

SEQ ID NO: 5189 - protein, 11 aa, Homo sapiens
GLLKPSETLSL

SEQ ID NO: 5190 - protein, 10 aa, Homo sapiens
GLLLLGGGLL

SEQ ID NO: 5191 - protein, 10 aa, Homo sapiens
GLLNSQNPFL

SEQ ID NO: 5192 - protein, 10 aa, Homo sapiens
GLLPAVKVFL

SEQ ID NO: 5193 - protein, 9 aa, Homo sapiens
GLLPSPLAV

SEQ ID NO: 5194 - protein, 10 aa, Homo sapiens
GLLPSPLAVA

SEQ ID NO: 5195 - protein, 9 aa, Homo sapiens
GLLQEVARI

SEQ ID NO: 5196 - protein, 11 aa, Homo sapiens
GLLQQPSALML

SEQ ID NO: 5197 - protein, 11 aa, Homo sapiens
GLLRDEALAEV

SEQ ID NO: 5198 - protein, 8 aa, Homo sapiens
GLLSDPEL

SEQ ID NO: 5199 - protein, 9 aa, Homo sapiens
GLLSIFTKV

SEQ ID NO: 5200 - protein, 10 aa, Homo sapiens
GLLSNPQAHV

SEQ ID NO: 5201 - protein, 9 aa, Homo sapiens
GLLSNVSHV

SEQ ID NO: 5202 - protein, 10 aa, Homo sapiens
GLLTGILETV

SEQ ID NO: 5203 - protein, 9 aa, Homo sapiens
GLLWQVIKI

SEQ ID NO: 5204 - protein, 11 aa, Homo sapiens
GLLYPTEDYKV

SEQ ID NO: 5205 - protein, 10 aa, Homo sapiens
GLMDGSPHFL

SEQ ID NO: 5206 - protein, 9 aa, Homo sapiens
GLMEDPMKV

SEQ ID NO: 5207 - protein, 11 aa, Homo sapiens
GLMGEGLAPHL

SEQ ID NO: 5208 - protein, 9 aa, Homo sapiens
GLMGISSTL

SEQ ID NO: 5209 - protein, 9 aa, Homo sapiens
GLMKIVKEA

SEQ ID NO: 5210 - protein, 9 aa, Homo sapiens
GLMLQHITL

SEQ ID NO: 5211 - protein, 9 aa, Homo sapiens
GLMNLPPSI

SEQ ID NO: 5212 - protein, 10 aa, Homo sapiens
GLMNRRDAIA

SEQ ID NO: 5213 - protein, 9 aa, Homo sapiens
GLMTSLVAV

SEQ ID NO: 5214 - protein, 9 aa, Homo sapiens
GLNSLTYQV

SEQ ID NO: 5215 - protein, 11 aa, Homo sapiens
GLQEKLKQLEP

SEQ ID NO: 5216 - protein, 9 aa, Homo sapiens
GLRESEEKL

SEQ ID NO: 5217 - protein, 9 aa, Homo sapiens
GLSAFLHAL

SEQ ID NO: 5218 - protein, 10 aa, Homo sapiens
GLSEKLLAYV

SEQ ID NO: 5219 - protein, 9 aa, Homo sapiens
GLSEQIREL

SEQ ID NO: 5220 - protein, 9 aa, Homo sapiens
GLSGIIPTL

SEQ ID NO: 5221 - protein, 10 aa, Homo sapiens
GLSIADQITL

SEQ ID NO: 5222 - protein, 9 aa, Homo sapiens
GLSPLSPTV

SEQ ID NO: 5223 - protein, 9 aa, Homo sapiens
GLSSLSIHL

SEQ ID NO: 5224 - protein, 10 aa, Homo sapiens
GLTETGLYRI

SEQ ID NO: 5225 - protein, 9 aa, Homo sapiens
GLTEVTQSL

SEQ ID NO: 5226 - protein, 10 aa, Homo sapiens
GLTHTAVVPL

SEQ ID NO: 5227 - protein, 9 aa, Homo sapiens
GLTIVIAGM

SEQ ID NO: 5228 - protein, 9 aa, Homo sapiens
GLTSGRWFL

SEQ ID NO: 5229 - protein, 10 aa, Homo sapiens
GLTVKIGDFG

SEQ ID NO: 5230 - protein, 9 aa, Homo sapiens
GLVATVKEA

SEQ ID NO: 5231 - protein, 9 aa, Homo sapiens
GLVDKFPHL

SEQ ID NO: 5232 - protein, 9 aa, Homo sapiens
GLVEQLYDL

SEQ ID NO: 5233 - protein, 9 aa, Homo sapiens
GLVNDLARV

SEQ ID NO: 5234 - protein, 9 aa, Homo sapiens
GLVNYQISV

SEQ ID NO: 5235 - protein, 9 aa, Homo sapiens
GLVRPPPGL

SEQ ID NO: 5236 - protein, 9 aa, Homo sapiens
GLVVVNHYL

SEQ ID NO: 5237 - protein, 10 aa, Homo sapiens
GLWEGALYEI

SEQ ID NO: 5238 - protein, 10 aa, Homo sapiens
GLWHGVLTSV

SEQ ID NO: 5239 - protein, 9 aa, Homo sapiens
GLWKDSLFL

SEQ ID NO: 5240 - protein, 10 aa, Homo sapiens
GLYDGPVCEV

SEQ ID NO: 5241 - protein, 9 aa, Homo sapiens
GLYEKMEQV

SEQ ID NO: 5242 - protein, 9 aa, Homo sapiens
GLYEQAFQL

SEQ ID NO: 5243 - protein, 9 aa, Homo sapiens
GLYERPTAA

SEQ ID NO: 5244 - protein, 9 aa, Homo sapiens
GLYETVNEV

SEQ ID NO: 5245 - protein, 9 aa, Homo sapiens
GLYHTSPSL

SEQ ID NO: 5246 - protein, 10 aa, Toxoplasma gondii ME49
GMLDPLEVHL

SEQ ID NO: 5247 - protein, 11 aa, Homo sapiens
GMWNPNAPVFL

SEQ ID NO: 5248 - protein, 9 aa, Homo sapiens
GMYETPLFL

SEQ ID NO: 5249 - protein, 9 aa, Homo sapiens
GQVERFETV

SEQ ID NO: 5250 - protein, 9 aa, Homo sapiens
GSLGLIFAL

SEQ ID NO: 5251 - protein, 10 aa, Homo sapiens
GVIAEILRGV

SEQ ID NO: 5252 - protein, 11 aa, Homo sapiens
GVIKVFNDMKV

SEQ ID NO: 5253 - protein, 11 aa, Homo sapiens
GVLEMERLHYI

SEQ ID NO: 5254 - protein, 10 aa, Homo sapiens
GVMAGDIYSV

SEQ ID NO: 5255 - protein, 9 aa, Homo sapiens
GVMESVIAL

SEQ ID NO: 5256 - protein, 11 aa, Homo sapiens
HILEEKGLSQV

SEQ ID NO: 5257 - protein, 10 aa, Homo sapiens
HLADLADFAL

SEQ ID NO: 5258 - protein, 11 aa, Homo sapiens
HLADLPVEPHL

SEQ ID NO: 5259 - protein, 11 aa, Homo sapiens
HLAEFHQIEGV

SEQ ID NO: 5260 - protein, 9 aa, Homo sapiens
HLAEVSAEV

SEQ ID NO: 5261 - protein, 9 aa, Homo sapiens
HLAKLVSLV

SEQ ID NO: 5262 - protein, 9 aa, Homo sapiens
HLANIVERL

SEQ ID NO: 5263 - protein, 9 aa, Homo sapiens
HLANTYISV

SEQ ID NO: 5264 - protein, 9 aa, Homo sapiens
HLAPNTFNV

SEQ ID NO: 5265 - protein, 9 aa, Homo sapiens
HLDEAIHVL

SEQ ID NO: 5266 - protein, 9 aa, Homo sapiens
HLDKKTQTP

SEQ ID NO: 5267 - protein, 10 aa, Homo sapiens
HLDLPSNNNL

SEQ ID NO: 5268 - protein, 9 aa, Homo sapiens
HLDPAVKEV

SEQ ID NO: 5269 - protein, 9 aa, Homo sapiens
HLDRLVPLV

SEQ ID NO: 5270 - protein, 9 aa, Homo sapiens
HLDTVPPSV

SEQ ID NO: 5271 - protein, 9 aa, Homo sapiens
HLDVKPANI

SEQ ID NO: 5272 - protein, 9 aa, Homo sapiens
HLFDAFVSV

SEQ ID NO: 5273 - protein, 9 aa, Homo sapiens
HLFDTLHAL

SEQ ID NO: 5274 - protein, 11 aa, Homo sapiens
HLFEDAYLLTL

SEQ ID NO: 5275 - protein, 10 aa, Homo sapiens
HLFEGSNTSL

SEQ ID NO: 5276 - protein, 9 aa, Homo sapiens
HLFENLLRL

SEQ ID NO: 5277 - protein, 9 aa, Homo sapiens
HLFEYYHRL

SEQ ID NO: 5278 - protein, 9 aa, Homo sapiens
HLFGALVLL

SEQ ID NO: 5279 - protein, 9 aa, Homo sapiens
HLFKDKVVL

SEQ ID NO: 5280 - protein, 9 aa, Homo sapiens
HLFRDVAEV

SEQ ID NO: 5281 - protein, 9 aa, Homo sapiens
HLFTATINL

SEQ ID NO: 5282 - protein, 9 aa, Homo sapiens
HLGDRPIPV

SEQ ID NO: 5283 - protein, 9 aa, Homo sapiens
HLGEYQAAV

SEQ ID NO: 5284 - protein, 9 aa, Homo sapiens
HLIEAVEAI

SEQ ID NO: 5285 - protein, 9 aa, Homo sapiens
HLIEESVKL

SEQ ID NO: 5286 - protein, 10 aa, Homo sapiens
HLIEQDFPGM

SEQ ID NO: 5287 - protein, 9 aa, Homo sapiens
HLIHEVTKV

SEQ ID NO: 5288 - protein, 10 aa, Homo sapiens
HLINVEGVGV

SEQ ID NO: 5289 - protein, 9 aa, Homo sapiens
HLISTINTV

SEQ ID NO: 5290 - protein, 10 aa, Homo sapiens
HLKEDQTEYL

SEQ ID NO: 5291 - protein, 11 aa, Homo sapiens
HLLDHLSIVYV

SEQ ID NO: 5292 - protein, 9 aa, Homo sapiens
HLLDNTERL

SEQ ID NO: 5293 - protein, 9 aa, Homo sapiens
HLLEADIKL

SEQ ID NO: 5294 - protein, 10 aa, Homo sapiens
HLLEGQNASV

SEQ ID NO: 5295 - protein, 9 aa, Homo sapiens
HLLERSWYA

SEQ ID NO: 5296 - protein, 9 aa, Homo sapiens
HLLGRLAAI

SEQ ID NO: 5297 - protein, 11 aa, Homo sapiens
HLLGSEQQSSV

SEQ ID NO: 5298 - protein, 9 aa, Homo sapiens
HLLPHVLQV

SEQ ID NO: 5299 - protein, 9 aa, Homo sapiens
HLLPTQLEV

SEQ ID NO: 5300 - protein, 9 aa, Homo sapiens
HLLQELSQV

SEQ ID NO: 5301 - protein, 9 aa, Homo sapiens
HLLRFLEAV

SEQ ID NO: 5302 - protein, 9 aa, Homo sapiens
HLLTHIQAV

SEQ ID NO: 5303 - protein, 9 aa, Homo sapiens
HLMHTSYFL

SEQ ID NO: 5304 - protein, 9 aa, Homo sapiens
HLMPHLLTL

SEQ ID NO: 5305 - protein, 9 aa, Homo sapiens
HLMQTSFQL

SEQ ID NO: 5306 - protein, 9 aa, Homo sapiens
HLMTKVEEL

SEQ ID NO: 5307 - protein, 9 aa, Homo sapiens
HLPPTFHAV

SEQ ID NO: 5308 - protein, 9 aa, Homo sapiens
HLQEKLQSL

SEQ ID NO: 5309 - protein, 9 aa, Homo sapiens
HLSDAIVEV

SEQ ID NO: 5310 - protein, 9 aa, Homo sapiens
HLSDHLSEL

SEQ ID NO: 5311 - protein, 9 aa, Homo sapiens
HLSDLALTL

SEQ ID NO: 5312 - protein, 9 aa, Homo sapiens
HLSSIEVLI

SEQ ID NO: 5313 - protein, 9 aa, Homo sapiens
HLTEDTPKV

SEQ ID NO: 5314 - protein, 9 aa, Homo sapiens
HLTEMQAKV

SEQ ID NO: 5315 - protein, 9 aa, Homo sapiens
HLTEVLTLV

SEQ ID NO: 5316 - protein, 9 aa, Homo sapiens
HLTLVEAIK

SEQ ID NO: 5317 - protein, 10 aa, Homo sapiens
HLVPAWDHTL

SEQ ID NO: 5318 - protein, 11 aa, Homo sapiens
HLWDLQDRVLV

SEQ ID NO: 5319 - protein, 9 aa, Homo sapiens
HLWGHALFL

SEQ ID NO: 5320 - protein, 9 aa, Homo sapiens
HLWSYLITL

SEQ ID NO: 5321 - protein, 11 aa, Homo sapiens
HLYDKGSTIFL

SEQ ID NO: 5322 - protein, 9 aa, Homo sapiens
HLYDYTVKL

SEQ ID NO: 5323 - protein, 10 aa, Homo sapiens
HLYEEKFESI

SEQ ID NO: 5324 - protein, 10 aa, Homo sapiens
HLYRGIFPVL

SEQ ID NO: 5325 - protein, 9 aa, Homo sapiens
HLYSRIPGL

SEQ ID NO: 5326 - protein, 9 aa, Homo sapiens
HTDDHMALL

SEQ ID NO: 5327 - protein, 9 aa, Homo sapiens
IIDGKIFCV

SEQ ID NO: 5328 - protein, 11 aa, Homo sapiens
ILADLPRNIML

SEQ ID NO: 5329 - protein, 9 aa, Homo sapiens
ILAEGITIV

SEQ ID NO: 5330 - protein, 9 aa, Homo sapiens
ILAELLLRV

SEQ ID NO: 5331 - protein, 9 aa, Homo sapiens
ILAENILSI

SEQ ID NO: 5332 - protein, 9 aa, Homo sapiens
ILAETQPEL

SEQ ID NO: 5333 - protein, 11 aa, Homo sapiens
ILAGTSGLQQV

SEQ ID NO: 5334 - protein, 11 aa, Homo sapiens
ILANDGVLLAA

SEQ ID NO: 5335 - protein, 9 aa, Homo sapiens
ILANNCPAL

SEQ ID NO: 5336 - protein, 9 aa, Homo sapiens
ILAPELSHA

SEQ ID NO: 5337 - protein, 9 aa, Homo sapiens
ILAPSLAKV

SEQ ID NO: 5338 - protein, 9 aa, Homo sapiens
ILAPTVQEL

SEQ ID NO: 5339 - protein, 11 aa, Homo sapiens
ILAQEQLVVGV

SEQ ID NO: 5340 - protein, 9 aa, Homo sapiens
ILATAVYQA

SEQ ID NO: 5341 - protein, 9 aa, Homo sapiens
ILATMNVPA

SEQ ID NO: 5342 - protein, 11 aa, Homo sapiens
ILDAAGANLKV

SEQ ID NO: 5343 - protein, 9 aa, Homo sapiens
ILDDIIASV

SEQ ID NO: 5344 - protein, 10 aa, Homo sapiens
ILDDVSLTHL

SEQ ID NO: 5345 - protein, 10 aa, Homo sapiens
ILDEAHERTI

SEQ ID NO: 5346 - protein, 10 aa, Homo sapiens
ILDEAHERTL

SEQ ID NO: 5347 - protein, 9 aa, Homo sapiens
ILDEMSHKL

SEQ ID NO: 5348 - protein, 9 aa, Homo sapiens
ILDEPTNHL

SEQ ID NO: 5349 - protein, 9 aa, Homo sapiens
ILDEPTNNL

SEQ ID NO: 5350 - protein, 9 aa, Homo sapiens
ILDESHERV

SEQ ID NO: 5351 - protein, 9 aa, Homo sapiens
ILDEVIFKL

SEQ ID NO: 5352 - protein, 9 aa, Homo sapiens
ILDKATEYI

SEQ ID NO: 5353 - protein, 9 aa, Homo sapiens
ILDQSRETV

SEQ ID NO: 5354 - protein, 9 aa, Homo sapiens
ILDQTNVSA

SEQ ID NO: 5355 - protein, 9 aa, Homo sapiens
ILDRLTTKV

SEQ ID NO: 5356 - protein, 9 aa, Homo sapiens
ILDRMLPEL

SEQ ID NO: 5357 - protein, 10 aa, Homo sapiens
ILDSGATHTT

SEQ ID NO: 5358 - protein, 9 aa, Homo sapiens
ILDSVLHHL

SEQ ID NO: 5359 - protein, 9 aa, Homo sapiens
ILEENIPVL

SEQ ID NO: 5360 - protein, 11 aa, Homo sapiens
ILEEQPMDMLL

SEQ ID NO: 5361 - protein, 11 aa, Homo sapiens
ILFELLKSLEA

SEQ ID NO: 5362 - protein, 9 aa, Homo sapiens
ILFGLIKDV

SEQ ID NO: 5363 - protein, 9 aa, Homo sapiens
ILFNKLWEL

SEQ ID NO: 5364 - protein, 11 aa, Homo sapiens
ILFPIKQPITV

SEQ ID NO: 5365 - protein, 9 aa, Homo sapiens
ILGDFLVAV

SEQ ID NO: 5366 - protein, 9 aa, Homo sapiens
ILGDILLSA

SEQ ID NO: 5367 - protein, 10 aa, Homo sapiens
ILGGLFPVHA

SEQ ID NO: 5368 - protein, 11 aa, Homo sapiens
ILGGPGTVQGV

SEQ ID NO: 5369 - protein, 9 aa, Homo sapiens
ILGPKPQGV

SEQ ID NO: 5370 - protein, 11 aa, Homo sapiens
ILGPPPPSFHL

SEQ ID NO: 5371 - protein, 11 aa, Homo sapiens
ILGTEDLIVEV

SEQ ID NO: 5372 - protein, 9 aa, Homo sapiens
ILGTHNITV

SEQ ID NO: 5373 - protein, 9 aa, Homo sapiens
ILHENFTTV

SEQ ID NO: 5374 - protein, 9 aa, Homo sapiens
ILHGLVAAV

SEQ ID NO: 5375 - protein, 9 aa, Homo sapiens
ILHHVNIGL

SEQ ID NO: 5376 - protein, 9 aa, Homo sapiens
ILHSVTTNL

SEQ ID NO: 5377 - protein, 9 aa, Homo sapiens
ILHTLLTLV

SEQ ID NO: 5378 - protein, 9 aa, Homo sapiens
ILIDEVDKI

SEQ ID NO: 5379 - protein, 11 aa, Homo sapiens
ILIDKSGKLEL

SEQ ID NO: 5380 - protein, 9 aa, Homo sapiens
ILIKGLAKL

SEQ ID NO: 5381 - protein, 9 aa, Homo sapiens
ILIPNVETI

SEQ ID NO: 5382 - protein, 10 aa, Homo sapiens
ILKDVIPPLE

SEQ ID NO: 5383 - protein, 9 aa, Homo sapiens
ILKETIEIL

SEQ ID NO: 5384 - protein, 9 aa, Homo sapiens
ILKQLQIIL

SEQ ID NO: 5385 - protein, 9 aa, Homo sapiens
ILKSALQVE

SEQ ID NO: 5386 - protein, 11 aa, Homo sapiens
ILLAEGRLVNL

SEQ ID NO: 5387 - protein, 9 aa, Homo sapiens
ILLAEVDKV

SEQ ID NO: 5388 - protein, 11 aa, Homo sapiens
ILLDDNMQIRL

SEQ ID NO: 5389 - protein, 11 aa, Homo sapiens
ILLDDQFQPKL

SEQ ID NO: 5390 - protein, 11 aa, Homo sapiens
ILLDEEGHIKI

SEQ ID NO: 5391 - protein, 11 aa, Homo sapiens
ILLDEEGHIKL

SEQ ID NO: 5392 - protein, 11 aa, Homo sapiens
ILLDHEKEWKL

SEQ ID NO: 5393 - protein, 10 aa, Homo sapiens
ILLDKLLIRL

SEQ ID NO: 5394 - protein, 11 aa, Homo sapiens
ILLEELDLEKL

SEQ ID NO: 5395 - protein, 9 aa, Homo sapiens
ILLEGTMNL

SEQ ID NO: 5396 - protein, 9 aa, Homo sapiens
ILLEHIIMC

SEQ ID NO: 5397 - protein, 9 aa, Homo sapiens
ILLEHKVVL

SEQ ID NO: 5398 - protein, 9 aa, Homo sapiens
ILLEMIHSI

SEQ ID NO: 5399 - protein, 10 aa, Homo sapiens
ILLESHMVMI

SEQ ID NO: 5400 - protein, 11 aa, Homo sapiens
ILLGRIKDLEL

SEQ ID NO: 5401 - protein, 8 aa, Artificial Sequence
  unknown
ILLGVNSY

SEQ ID NO: 5402 - protein, 9 aa, Homo sapiens
ILLHQVEAL

SEQ ID NO: 5403 - protein, 9 aa, Homo sapiens
ILLKALTNL

SEQ ID NO: 5404 - protein, 9 aa, Homo sapiens
ILLKEIILV

SEQ ID NO: 5405 - protein, 11 aa, Homo sapiens
ILLNEDDLVTI

SEQ ID NO: 5406 - protein, 9 aa, Homo sapiens
ILLNIIERL

SEQ ID NO: 5407 - protein, 11 aa, Homo sapiens
ILLPEEQQLLL

SEQ ID NO: 5408 - protein, 9 aa, Artificial Sequence
  unknown
ILLPFTEQL

SEQ ID NO: 5409 - protein, 9 aa, Homo sapiens
ILLPRIIEA

SEQ ID NO: 5410 - protein, 9 aa, Homo sapiens
ILLPRPPQV

SEQ ID NO: 5411 - protein, 9 aa, Homo sapiens
ILLQQQQQL

SEQ ID NO: 5412 - protein, 11 aa, Homo sapiens
ILLQVAALKYI

SEQ ID NO: 5413 - protein, 10 aa, Homo sapiens
ILLSGASPFL

SEQ ID NO: 5414 - protein, 11 aa, Homo sapiens
ILLTEPGQVKL

SEQ ID NO: 5415 - protein, 9 aa, Homo sapiens
ILMDERTFL

SEQ ID NO: 5416 - protein, 8 aa, Homo sapiens
ILMEHIHK

SEQ ID NO: 5417 - protein, 9 aa, Homo sapiens
ILMEKYLKL

SEQ ID NO: 5418 - protein, 9 aa, Homo sapiens
ILMGHSLYM

SEQ ID NO: 5419 - protein, 9 aa, Homo sapiens
ILMHSPPSA

SEQ ID NO: 5420 - protein, 11 aa, Homo sapiens
ILMPNGAVAAV

SEQ ID NO: 5421 - protein, 9 aa, Homo sapiens
ILMQNIETV

SEQ ID NO: 5422 - protein, 11 aa, Homo sapiens
ILMSPNSYIKL

SEQ ID NO: 5423 - protein, 11 aa, Homo sapiens
ILNDPSQSEVM

SEQ ID NO: 5424 - protein, 10 aa, Homo sapiens
ILNEFPGHGL

SEQ ID NO: 5425 - protein, 9 aa, Homo sapiens
ILNEIVNFV

SEQ ID NO: 5426 - protein, 9 aa, Homo sapiens
ILNEQAAKV

SEQ ID NO: 5427 - protein, 10 aa, Homo sapiens
ILNETGKILL

SEQ ID NO: 5428 - protein, 9 aa, Homo sapiens
ILNEVDISV

SEQ ID NO: 5429 - protein, 9 aa, Homo sapiens
ILNNHTWNL

SEQ ID NO: 5430 - protein, 9 aa, Homo sapiens
ILNPHVHVI

SEQ ID NO: 5431 - protein, 9 aa, Homo sapiens
ILNSTTIEI

SEQ ID NO: 5432 - protein, 9 aa, Homo sapiens
ILNTLNITV

SEQ ID NO: 5433 - protein, 9 aa, Homo sapiens
ILNYVLVRV

SEQ ID NO: 5434 - protein, 10 aa, Homo sapiens
ILPGSLTASL

SEQ ID NO: 5435 - protein, 9 aa, Homo sapiens
ILQDLQPFL

SEQ ID NO: 5436 - protein, 10 aa, Homo sapiens
ILQDLTFVHL

SEQ ID NO: 5437 - protein, 9 aa, Homo sapiens
ILQEFESKL

SEQ ID NO: 5438 - protein, 11 aa, Homo sapiens
ILQENLKDIML

SEQ ID NO: 5439 - protein, 9 aa, Homo sapiens
ILQESLIKL

SEQ ID NO: 5440 - protein, 8 aa, Homo sapiens
ILQLSLAL

SEQ ID NO: 5441 - protein, 9 aa, Homo sapiens
ILQPMDIHV

SEQ ID NO: 5442 - protein, 10 aa, Homo sapiens
ILQSKEPAYV

SEQ ID NO: 5443 - protein, 10 aa, Homo sapiens
ILQTIESGGL

SEQ ID NO: 5444 - protein, 9 aa, Homo sapiens
ILRAILEVL

SEQ ID NO: 5445 - protein, 9 aa, Homo sapiens
ILRDTSEDL

SEQ ID NO: 5446 - protein, 9 aa, Homo sapiens
ILSEFSSKL

SEQ ID NO: 5447 - protein, 9 aa, Homo sapiens
ILSEIKEAV

SEQ ID NO: 5448 - protein, 9 aa, Homo sapiens
ILSELLSNL

SEQ ID NO: 5449 - protein, 9 aa, Homo sapiens
ILSESLHSL

SEQ ID NO: 5450 - protein, 9 aa, Homo sapiens
ILSGNAAHW

SEQ ID NO: 5451 - protein, 9 aa, Homo sapiens
ILSGNTAHW

SEQ ID NO: 5452 - protein, 9 aa, Homo sapiens
ILSRVTESV

SEQ ID NO: 5453 - protein, 9 aa, Homo sapiens
ILSVVNSQL

SEQ ID NO: 5454 - protein, 9 aa, Homo sapiens
ILTEAIKAC

SEQ ID NO: 5455 - protein, 10 aa, Homo sapiens
ILTELGGFEV

SEQ ID NO: 5456 - protein, 9 aa, Homo sapiens
ILTEVNYEV

SEQ ID NO: 5457 - protein, 9 aa, Homo sapiens
ILTGTPPGV

SEQ ID NO: 5458 - protein, 9 aa, Homo sapiens
ILTKILYLI

SEQ ID NO: 5459 - protein, 9 aa, Homo sapiens
ILTKILYLL

SEQ ID NO: 5460 - protein, 9 aa, Homo sapiens
ILTQSVENV

SEQ ID NO: 5461 - protein, 9 aa, Homo sapiens
ILTSIQSLL

SEQ ID NO: 5462 - protein, 9 aa, Homo sapiens
ILTTLIHLV

SEQ ID NO: 5463 - protein, 9 aa, Homo sapiens
ILHGLVAAV

SEQ ID NO: 5464 - protein, 11 aa, Homo sapiens
ILVEESNVQRV

SEQ ID NO: 5465 - protein, 9 aa, Homo sapiens
ILVEKFPFV

SEQ ID NO: 5466 - protein, 9 aa, Homo sapiens
ILVESEAHV

SEQ ID NO: 5467 - protein, 10 aa, Homo sapiens
ILVIGAIVKN

SEQ ID NO: 5468 - protein, 10 aa, Homo sapiens
ILVQIEQLYV

SEQ ID NO: 5469 - protein, 9 aa, Homo sapiens
ILVSWLPRL

SEQ ID NO: 5470 - protein, 10 aa, Homo sapiens
ILWFRCLLLL

SEQ ID NO: 5471 - protein, 9 aa, Homo sapiens
ILWHFVASL

SEQ ID NO: 5472 - protein, 11 aa, Homo sapiens
ILYDHVHPVGA

SEQ ID NO: 5473 - protein, 9 aa, Homo sapiens
ILYDKYFSL

SEQ ID NO: 5474 - protein, 9 aa, Homo sapiens
ILYGTQFVL

SEQ ID NO: 5475 - protein, 10 aa, Homo sapiens
ILYSGSGILR

SEQ ID NO: 5476 - protein, 9 aa, Homo sapiens
IMDATNILV

SEQ ID NO: 5477 - protein, 10 aa, Homo sapiens
IMLKGDNITL

SEQ ID NO: 5478 - protein, 9 aa, Homo sapiens
IMTLLASFL

SEQ ID NO: 5479 - protein, 8 aa, Homo sapiens
IQDVVQPL

SEQ ID NO: 5480 - protein, 9 aa, Homo sapiens
IQHSEFEEV

SEQ ID NO: 5481 - protein, 11 aa, Homo sapiens
IQLPSEKAIFL

SEQ ID NO: 5482 - protein, 8 aa, Homo sapiens
IQNELAAI

SEQ ID NO: 5483 - protein, 9 aa, Homo sapiens
IQYDRTLLV

SEQ ID NO: 5484 - protein, 10 aa, Homo sapiens
ISLLDLPLSL

SEQ ID NO: 5485 - protein, 9 aa, Homo sapiens
ISTEVNPKL

SEQ ID NO: 5486 - protein, 9 aa, Homo sapiens
IVAESLQQV

SEQ ID NO: 5487 - protein, 9 aa, Homo sapiens
IVKDEMISV

SEQ ID NO: 5488 - protein, 9 aa, Homo sapiens
IVVDNVPQV

SEQ ID NO: 5489 - protein, 9 aa, Homo sapiens
KAMDDTFYL

SEQ ID NO: 5490 - protein, 11 aa, Homo sapiens
KAVSSAAIAEV

SEQ ID NO: 5491 - protein, 9 aa, Homo sapiens
KAYHEQLTV

SEQ ID NO: 5492 - protein, 10 aa, Homo sapiens
KIADFGLARI

SEQ ID NO: 5493 - protein, 10 aa, Homo sapiens
KIFPAALQLV

SEQ ID NO: 5494 - protein, 11 aa, Homo sapiens
KIGDFGLVTSL

SEQ ID NO: 5495 - protein, 9 aa, Toxoplasma gondii ME49
KIGEGTYGV

SEQ ID NO: 5496 - protein, 9 aa, Homo sapiens
KIIDFLSAL

SEQ ID NO: 5497 - protein, 9 aa, Homo sapiens
KIIHWPWLV

SEQ ID NO: 5498 - protein, 10 aa, Homo sapiens
KIIYIVHDEV

SEQ ID NO: 5499 - protein, 9 aa, Homo sapiens
KILAHLWHL

SEQ ID NO: 5500 - protein, 10 aa, Homo sapiens
KILDIGLAYI

SEQ ID NO: 5501 - protein, 9 aa, Homo sapiens
KILEALQRV

SEQ ID NO: 5502 - protein, 10 aa, Homo sapiens
KILEDIGLYL

SEQ ID NO: 5503 - protein, 9 aa, Homo sapiens
KILEINPKL

SEQ ID NO: 5504 - protein, 9 aa, Homo sapiens
KILETLYTL

SEQ ID NO: 5505 - protein, 9 aa, Homo sapiens
KILPVMVTL

SEQ ID NO: 5506 - protein, 9 aa, Homo sapiens
KILRLSLIL

SEQ ID NO: 5507 - protein, 10 aa, Homo sapiens
KILSGVIRSV

SEQ ID NO: 5508 - protein, 10 aa, Homo sapiens
KIMDATNILV

SEQ ID NO: 5509 - protein, 11 aa, Homo sapiens
KIMDYSLLVGI

SEQ ID NO: 5510 - protein, 9 aa, Homo sapiens
KIMEQSPDM

SEQ ID NO: 5511 - protein, 9 aa, Homo sapiens
KINEAIVAV

SEQ ID NO: 5512 - protein, 9 aa, Homo sapiens
KISTITPQI

SEQ ID NO: 5513 - protein, 9 aa, Homo sapiens
KITEYLERV

SEQ ID NO: 5514 - protein, 9 aa, Homo sapiens
KIVPIAIQL

SEQ ID NO: 5515 - protein, 11 aa, Homo sapiens
KIWDLKERTNV

SEQ ID NO: 5516 - protein, 10 aa, Homo sapiens
KLADFGLARI

SEQ ID NO: 5517 - protein, 9 aa, Homo sapiens
KLADLSLRI

SEQ ID NO: 5518 - protein, 11 aa, Homo sapiens
KLADMNQEYQL

SEQ ID NO: 5519 - protein, 9 aa, Homo sapiens
KLADSIKAI

SEQ ID NO: 5520 - protein, 9 aa, Homo sapiens
KLAEENPDL

SEQ ID NO: 5521 - protein, 9 aa, Homo sapiens
KLAEFIDFL

SEQ ID NO: 5522 - protein, 10 aa, Homo sapiens
KLAEGLDIQL

SEQ ID NO: 5523 - protein, 11 aa, Homo sapiens
KLAEGSAYEEV

SEQ ID NO: 5524 - protein, 9 aa, Homo sapiens
KLAEGVQLL

SEQ ID NO: 5525 - protein, 11 aa, Homo sapiens
KLAELHGNMFV

SEQ ID NO: 5526 - protein, 9 aa, Homo sapiens
KLAENEITL

SEQ ID NO: 5527 - protein, 9 aa, Homo sapiens
KLAERLWSM

SEQ ID NO: 5528 - protein, 9 aa, Homo sapiens
KLAEVLEAV

SEQ ID NO: 5529 - protein, 9 aa, Homo sapiens
KLAEVSQNI

SEQ ID NO: 5530 - protein, 9 aa, Homo sapiens
KLAEVTKVV

SEQ ID NO: 5531 - protein, 10 aa, Homo sapiens
KLAEVTKVVV

SEQ ID NO: 5532 - protein, 10 aa, Homo sapiens
KLAMLTGVLL

SEQ ID NO: 5533 - protein, 9 aa, Homo sapiens
KLAPPSSTL

SEQ ID NO: 5534 - protein, 9 aa, Homo sapiens
KLAQALHEM

SEQ ID NO: 5535 - protein, 10 aa, Homo sapiens
KLAQANGWGV

SEQ ID NO: 5536 - protein, 9 aa, Homo sapiens
KLAQWLWGL

SEQ ID NO: 5537 - protein, 9 aa, Homo sapiens
KLDDIVQHI

SEQ ID NO: 5538 - protein, 9 aa, Homo sapiens
KLDDTYIKA

SEQ ID NO: 5539 - protein, 9 aa, Homo sapiens
KLDEDVKMI

SEQ ID NO: 5540 - protein, 9 aa, Homo sapiens
KLDEILKEI

SEQ ID NO: 5541 - protein, 9 aa, Homo sapiens
KLDHINMNL

SEQ ID NO: 5542 - protein, 9 aa, Homo sapiens
KLDHTLSQI

SEQ ID NO: 5543 - protein, 9 aa, Homo sapiens
KLDVDAPRL

SEQ ID NO: 5544 - protein, 9 aa, Homo sapiens
KLEEIIHQI

SEQ ID NO: 5545 - protein, 9 aa, Homo sapiens
KLEEQLEKI

SEQ ID NO: 5546 - protein, 9 aa, Artificial Sequence
  unknown
KLENTLQDV

SEQ ID NO: 5547 - protein, 9 aa, Homo sapiens
KLEPHIYAV

SEQ ID NO: 5548 - protein, 8 aa, Homo sapiens
KLESIKEI

SEQ ID NO: 5549 - protein, 9 aa, Homo sapiens
KLFDASHSL

SEQ ID NO: 5550 - protein, 10 aa, Homo sapiens
KLFDIFSQQV

SEQ ID NO: 5551 - protein, 11 aa, Homo sapiens
KLFDLDEKLML

SEQ ID NO: 5552 - protein, 9 aa, Homo sapiens
KLFDNTVGA

SEQ ID NO: 5553 - protein, 9 aa, Homo sapiens
KLFDTQHRV

SEQ ID NO: 5554 - protein, 11 aa, Homo sapiens
KLFEDTKYTTL

SEQ ID NO: 5555 - protein, 9 aa, Homo sapiens
KLFEEIREI

SEQ ID NO: 5556 - protein, 11 aa, Homo sapiens
KLFEEIREILL

SEQ ID NO: 5557 - protein, 9 aa, Homo sapiens
KLFEFMHET

SEQ ID NO: 5558 - protein, 10 aa, Homo sapiens
KLFEGLKFFL

SEQ ID NO: 5559 - protein, 9 aa, Homo sapiens
KLFEKKYSV

SEQ ID NO: 5560 - protein, 10 aa, Homo sapiens
KLFENFLVDI

SEQ ID NO: 5561 - protein, 11 aa, Homo sapiens
KLFGLQEAMKV

SEQ ID NO: 5562 - protein, 9 aa, Homo sapiens
KLFGLVMAL

SEQ ID NO: 5563 - protein, 10 aa, Homo sapiens
KLFLPDGMEA

SEQ ID NO: 5564 - protein, 9 aa, Homo sapiens
KLFLQKINE

SEQ ID NO: 5565 - protein, 9 aa, Homo sapiens
KLFNDAIRL

SEQ ID NO: 5566 - protein, 11 aa, Homo sapiens
KLFNDAIRLAV

SEQ ID NO: 5567 - protein, 9 aa, Homo sapiens
KLFNEFIQL

SEQ ID NO: 5568 - protein, 9 aa, Homo sapiens
KLFPFYFHI

SEQ ID NO: 5569 - protein, 11 aa, Homo sapiens
KLFPGFEIETV

SEQ ID NO: 5570 - protein, 10 aa, Homo sapiens
KLFPQETLFL

SEQ ID NO: 5571 - protein, 10 aa, Homo sapiens
KLFQLPTPPL

SEQ ID NO: 5572 - protein, 10 aa, Homo sapiens
KLFSAKLEQL

SEQ ID NO: 5573 - protein, 9 aa, Homo sapiens
KLFSDLREI

SEQ ID NO: 5574 - protein, 10 aa, Homo sapiens
KLFSGVLMDL

SEQ ID NO: 5575 - protein, 9 aa, Homo sapiens
KLFSLEHFL

SEQ ID NO: 5576 - protein, 9 aa, Homo sapiens
KLGAVFNQV

SEQ ID NO: 5577 - protein, 9 aa, Homo sapiens
KLGDFGLLV

SEQ ID NO: 5578 - protein, 11 aa, Homo sapiens
KLGDFGLLVEL

SEQ ID NO: 5579 - protein, 11 aa, Artificial Sequence
  unidentified
KLKGSPDYLGG

SEQ ID NO: 5580 - protein, 9 aa, Artificial Sequence
  unidentified
LLDDLPPRV

SEQ ID NO: 5581 - protein, 9 aa, Artificial Sequence
  unidentified
LLGGQIATV

SEQ ID NO: 5582 - protein, 9 aa, Artificial Sequence
  unidentified
LLGRVQLVI

SEQ ID NO: 5583 - protein, 11 aa, Artificial Sequence
  unidentified
LLKGGAAASAI

SEQ ID NO: 5584 - protein, 9 aa, Artificial Sequence
  unidentified
LLLQTTVHA

SEQ ID NO: 5585 - protein, 9 aa, Artificial Sequence
  unidentified
LLLTEGTQV

SEQ ID NO: 5586 - protein, 9 aa, Artificial Sequence
  unidentified
LLRGPLLAL

SEQ ID NO: 5587 - protein, 10 aa, Homo sapiens
KLGDFPYVSI

SEQ ID NO: 5588 - protein, 8 aa, Homo sapiens
KLGDIMGV

SEQ ID NO: 5589 - protein, 9 aa, Homo sapiens
KLGDLFFRV

SEQ ID NO: 5590 - protein, 9 aa, Homo sapiens
KLGDLMVLL

SEQ ID NO: 5591 - protein, 9 aa, Homo sapiens
KLGEILANL

SEQ ID NO: 5592 - protein, 8 aa, Homo sapiens
KLGFTVTV

SEQ ID NO: 5593 - protein, 8 aa, Homo sapiens
KLGLAPQI

SEQ ID NO: 5594 - protein, 9 aa, Homo sapiens
KLGPEGELL

SEQ ID NO: 5595 - protein, 8 aa, Homo sapiens
KLGVSIQN

SEQ ID NO: 5596 - protein, 9 aa, Homo sapiens
KLHAVVETL

SEQ ID NO: 5597 - protein, 9 aa, Homo sapiens
KLHDEDLLL

SEQ ID NO: 5598 - protein, 10 aa, Homo sapiens
KLHDFGYRGV

SEQ ID NO: 5599 - protein, 9 aa, Homo sapiens
KLHDINAQM

SEQ ID NO: 5600 - protein, 9 aa, Homo sapiens
KLHDRLAQL

SEQ ID NO: 5601 - protein, 9 aa, Homo sapiens
KLHDSVVMV

SEQ ID NO: 5602 - protein, 10 aa, Homo sapiens
KLHGGIDILV

SEQ ID NO: 5603 - protein, 9 aa, Homo sapiens
KLHLILDYV

SEQ ID NO: 5604 - protein, 9 aa, Homo sapiens
KLHPGLLEV

SEQ ID NO: 5605 - protein, 9 aa, Homo sapiens
KLHRETFYL

SEQ ID NO: 5606 - protein, 9 aa, Homo sapiens
KLHSEDIEL

SEQ ID NO: 5607 - protein, 9 aa, Homo sapiens
KLIAVLESI

SEQ ID NO: 5608 - protein, 9 aa, Homo sapiens
KLIDFSAQI

SEQ ID NO: 5609 - protein, 10 aa, Homo sapiens
KLIDHQGLYL

SEQ ID NO: 5610 - protein, 10 aa, Homo sapiens
KLIDLEHLLF

SEQ ID NO: 5611 - protein, 9 aa, Homo sapiens
KLIDRENFV

SEQ ID NO: 5612 - protein, 9 aa, Homo sapiens
KLIEFLLKA

SEQ ID NO: 5613 - protein, 10 aa, Homo sapiens
KLIEGLPEKV

SEQ ID NO: 5614 - protein, 9 aa, Homo sapiens
KLIEILEQL

SEQ ID NO: 5615 - protein, 9 aa, Homo sapiens
KLIEKNYFL

SEQ ID NO: 5616 - protein, 10 aa, Homo sapiens
KLIETELLQL

SEQ ID NO: 5617 - protein, 11 aa, Homo sapiens
KLIEVDDERKL

SEQ ID NO: 5618 - protein, 10 aa, Homo sapiens
KLIGEELAQL

SEQ ID NO: 5619 - protein, 11 aa, Homo sapiens
KLIHPDEDISL

SEQ ID NO: 5620 - protein, 9 aa, Homo sapiens
KLIIKPDIQ

SEQ ID NO: 5621 - protein, 9 aa, Homo sapiens
KLIKTSPEL

SEQ ID NO: 5622 - protein, 9 aa, Homo sapiens
KLINQVNTI

SEQ ID NO: 5623 - protein, 9 aa, Homo sapiens
KLIQELKTA

SEQ ID NO: 5624 - protein, 9 aa, Homo sapiens
KLIQESPTV

SEQ ID NO: 5625 - protein, 11 aa, Homo sapiens
KLIQESPTVEL

SEQ ID NO: 5626 - protein, 9 aa, Homo sapiens
KLIQFLISL

SEQ ID NO: 5627 - protein, 9 aa, Homo sapiens
KLISSYYNV

SEQ ID NO: 5628 - protein, 11 aa, Homo sapiens
KLISTEVNPKL

SEQ ID NO: 5629 - protein, 10 aa, Homo sapiens
KLITAHVEPL

SEQ ID NO: 5630 - protein, 11 aa, Homo sapiens
KLITLASLLLQ

SEQ ID NO: 5631 - protein, 9 aa, Homo sapiens
KLIVKEYEV

SEQ ID NO: 5632 - protein, 10 aa, Homo sapiens
KLKDDEVAQL

SEQ ID NO: 5633 - protein, 10 aa, Homo sapiens
KLKEHLVFTV

SEQ ID NO: 5634 - protein, 10 aa, Homo sapiens
KLKQNEVANV

SEQ ID NO: 5635 - protein, 9 aa, Homo sapiens
KLKYYIPEV

SEQ ID NO: 5636 - protein, 9 aa, Homo sapiens
KLLAAILHL

SEQ ID NO: 5637 - protein, 9 aa, Homo sapiens
KLLAGFMGV

SEQ ID NO: 5638 - protein, 9 aa, Homo sapiens
KLLAKVEQL

SEQ ID NO: 5639 - protein, 9 aa, Homo sapiens
KLLAQVSKV

SEQ ID NO: 5640 - protein, 10 aa, Homo sapiens
KLLDATHVYM

SEQ ID NO: 5641 - protein, 9 aa, Homo sapiens
KLLDDIKML

SEQ ID NO: 5642 - protein, 10 aa, Homo sapiens
KLLDEAIQAV

SEQ ID NO: 5643 - protein, 11 aa, Homo sapiens
KLLDEDEIRGY

SEQ ID NO: 5644 - protein, 11 aa, Homo sapiens
KLLDEIESLTL

SEQ ID NO: 5645 - protein, 11 aa, Homo sapiens
KLLDELPIAKV

SEQ ID NO: 5646 - protein, 10 aa, Homo sapiens
KLLDERLVTL

SEQ ID NO: 5647 - protein, 11 aa, Homo sapiens
KLLDFGSLSNL

SEQ ID NO: 5648 - protein, 10 aa, Homo sapiens
KLLDFQEFTL

SEQ ID NO: 5649 - protein, 8 aa, Homo sapiens
KLLDISEL

SEQ ID NO: 5650 - protein, 9 aa, Homo sapiens
KLLDKISSV

SEQ ID NO: 5651 - protein, 9 aa, Homo sapiens
KLLDKLLVL

SEQ ID NO: 5652 - protein, 10 aa, Homo sapiens
KLLDKLQTYL

SEQ ID NO: 5653 - protein, 11 aa, Homo sapiens
KLLDLDDKLLM

SEQ ID NO: 5654 - protein, 9 aa, Homo sapiens
KLLDLKKQL

SEQ ID NO: 5655 - protein, 9 aa, Homo sapiens
KLLDMELEM

SEQ ID NO: 5656 - protein, 11 aa, Homo sapiens
KLLDPSTPVHI

SEQ ID NO: 5657 - protein, 9 aa, Homo sapiens
KLLDSMHEV

SEQ ID NO: 5658 - protein, 11 aa, Homo sapiens
KLLDSSTVTHL

SEQ ID NO: 5659 - protein, 11 aa, Homo sapiens
KLLDTMVDTFL

SEQ ID NO: 5660 - protein, 9 aa, Homo sapiens
KLLDTPIKN

SEQ ID NO: 5661 - protein, 10 aa, Homo sapiens
KLLEELSHQL

SEQ ID NO: 5662 - protein, 10 aa, Homo sapiens
KLLEFDQLQL

SEQ ID NO: 5663 - protein, 9 aa, Homo sapiens
KLLEFQLAL

SEQ ID NO: 5664 - protein, 10 aa, Homo sapiens
KLLEGQVIQL

SEQ ID NO: 5665 - protein, 10 aa, Homo sapiens
KLLEGTIVNV

SEQ ID NO: 5666 - protein, 9 aa, Homo sapiens
KLLEIMTRI

SEQ ID NO: 5667 - protein, 11 aa, Homo sapiens
KLLEPDDKLFI

SEQ ID NO: 5668 - protein, 9 aa, Homo sapiens
KLLEQVNRI

SEQ ID NO: 5669 - protein, 9 aa, Homo sapiens
KLLESWLTL

SEQ ID NO: 5670 - protein, 11 aa, Homo sapiens
KLLETELLQEI

SEQ ID NO: 5671 - protein, 10 aa, Homo sapiens
KLLETESFQM

SEQ ID NO: 5672 - protein, 9 aa, Homo sapiens
KLLETMQHL

SEQ ID NO: 5673 - protein, 9 aa, Homo sapiens
KLLEVQILE

SEQ ID NO: 5674 - protein, 10 aa, Homo sapiens
KLLEVQILEV

SEQ ID NO: 5675 - protein, 11 aa, Homo sapiens
KLLEVSDDPQV

SEQ ID NO: 5676 - protein, 9 aa, Homo sapiens
KLLGALLLL

SEQ ID NO: 5677 - protein, 9 aa, Homo sapiens
KLLGKVETA

SEQ ID NO: 5678 - protein, 10 aa, Homo sapiens
KLLGPKINFV

SEQ ID NO: 5679 - protein, 9 aa, Homo sapiens
KLLGTVVAL

SEQ ID NO: 5680 - protein, 9 aa, Homo sapiens
KLLHSENYV

SEQ ID NO: 5681 - protein, 9 aa, Homo sapiens
KLLKYLEAV

SEQ ID NO: 5682 - protein, 9 aa, Homo sapiens
KLLLRLPAL

SEQ ID NO: 5683 - protein, 9 aa, Homo sapiens
KLLLRLPSL

SEQ ID NO: 5684 - protein, 9 aa, Homo sapiens
KLLNHVTQL

SEQ ID NO: 5685 - protein, 9 aa, Homo sapiens
KLLNLISKL

SEQ ID NO: 5686 - protein, 11 aa, Homo sapiens
KLLPDTILEKL

SEQ ID NO: 5687 - protein, 9 aa, Homo sapiens
KLLPETVTI

SEQ ID NO: 5688 - protein, 9 aa, Homo sapiens
KLLPFNPQL

SEQ ID NO: 5689 - protein, 10 aa, Homo sapiens
KLLPLAGLYL

SEQ ID NO: 5690 - protein, 9 aa, Homo sapiens
KLLQDLHEA

SEQ ID NO: 5691 - protein, 10 aa, Homo sapiens
KLLQEHDIEL

SEQ ID NO: 5692 - protein, 9 aa, Homo sapiens
KLLQELYKL

SEQ ID NO: 5693 - protein, 9 aa, Homo sapiens
KLLQESYKL

SEQ ID NO: 5694 - protein, 11 aa, Homo sapiens
KLLQLDKEFQL

SEQ ID NO: 5695 - protein, 8 aa, Homo sapiens
KLLSAVDI

SEQ ID NO: 5696 - protein, 9 aa, Homo sapiens
KLLSEALEL

SEQ ID NO: 5697 - protein, 9 aa, Homo sapiens
KLLSFTHKL

SEQ ID NO: 5698 - protein, 9 aa, Homo sapiens
KLLSRYLTL

SEQ ID NO: 5699 - protein, 9 aa, Homo sapiens
KLLSSVKEI

SEQ ID NO: 5700 - protein, 9 aa, Homo sapiens
KLLVELKVI

SEQ ID NO: 5701 - protein, 10 aa, Homo sapiens
KLLWGDIMEL

SEQ ID NO: 5702 - protein, 10 aa, Homo sapiens
KLMALGPIRL

SEQ ID NO: 5703 - protein, 10 aa, Homo sapiens
KLMDEVIKSM

SEQ ID NO: 5704 - protein, 10 aa, Homo sapiens
KLMDLRNEYL

SEQ ID NO: 5705 - protein, 11 aa, Homo sapiens
KLMDPGSLPPL

SEQ ID NO: 5706 - protein, 9 aa, Homo sapiens
KLMDYIDEL

SEQ ID NO: 5707 - protein, 11 aa, Homo sapiens
KLMDYSLLVGI

SEQ ID NO: 5708 - protein, 9 aa, Homo sapiens
KLMEEIREL

SEQ ID NO: 5709 - protein, 9 aa, Homo sapiens
KLMEKEEKL

SEQ ID NO: 5710 - protein, 9 aa, Homo sapiens
KLMELYERL

SEQ ID NO: 5711 - protein, 10 aa, Homo sapiens
KLMENPPREA

SEQ ID NO: 5712 - protein, 9 aa, Homo sapiens
KLMGVETVV

SEQ ID NO: 5713 - protein, 9 aa, Homo sapiens
KLMKKLLEA

SEQ ID NO: 5714 - protein, 11 aa, Homo sapiens
KLMNDDTLVNV

SEQ ID NO: 5715 - protein, 10 aa, Homo sapiens
KLMNVDPDSV

SEQ ID NO: 5716 - protein, 9 aa, Homo sapiens
KLMPVIMII

SEQ ID NO: 5717 - protein, 9 aa, Homo sapiens
KLMSDLQKL

SEQ ID NO: 5718 - protein, 9 aa, Homo sapiens
KLMSEVQTL

SEQ ID NO: 5719 - protein, 10 aa, Homo sapiens
KLMSLGDIRL

SEQ ID NO: 5720 - protein, 9 aa, Homo sapiens
KLNAKLAEL

SEQ ID NO: 5721 - protein, 9 aa, Homo sapiens
KLNDLIQRL

SEQ ID NO: 5722 - protein, 9 aa, Homo sapiens
KLNEVYEAV

SEQ ID NO: 5723 - protein, 9 aa, Homo sapiens
KLNNFNSYL

SEQ ID NO: 5724 - protein, 10 aa, Homo sapiens
KLNPAANHRL

SEQ ID NO: 5725 - protein, 9 aa, Homo sapiens
KLNSWIQGV

SEQ ID NO: 5726 - protein, 9 aa, Homo sapiens
KLPDGTWNL

SEQ ID NO: 5727 - protein, 8 aa, Homo sapiens
KLPIAPLI

SEQ ID NO: 5728 - protein, 11 aa, Homo sapiens
KLPSETIFVGC

SEQ ID NO: 5729 - protein, 9 aa, Homo sapiens
KLPSFLANV

SEQ ID NO: 5730 - protein, 9 aa, Homo sapiens
KLQAQDPQI

SEQ ID NO: 5731 - protein, 9 aa, Homo sapiens
KLQDASAEV

SEQ ID NO: 5732 - protein, 9 aa, Homo sapiens
KLQDELKLL

SEQ ID NO: 5733 - protein, 9 aa, Homo sapiens
KLQDGLLHI

SEQ ID NO: 5734 - protein, 9 aa, Homo sapiens
KLQDLIEEI

SEQ ID NO: 5735 - protein, 9 aa, Homo sapiens
KLQDNLRQL

SEQ ID NO: 5736 - protein, 9 aa, Homo sapiens
KLQEANAQL

SEQ ID NO: 5737 - protein, 9 aa, Homo sapiens
KLQEEIEKI

SEQ ID NO: 5738 - protein, 9 aa, Homo sapiens
KLQEELERL

SEQ ID NO: 5739 - protein, 11 aa, Homo sapiens
KLQEEVKDLRA

SEQ ID NO: 5740 - protein, 10 aa, Homo sapiens
KLQEFELPYV

SEQ ID NO: 5741 - protein, 9 aa, Homo sapiens
KLQEIENAI

SEQ ID NO: 5742 - protein, 9 aa, Homo sapiens
KLQEKLDEL

SEQ ID NO: 5743 - protein, 9 aa, Homo sapiens
KLQEKVELL

SEQ ID NO: 5744 - protein, 9 aa, Homo sapiens
KLQEQLAQL

SEQ ID NO: 5745 - protein, 10 aa, Homo sapiens
KLQEQLEATV

SEQ ID NO: 5746 - protein, 9 aa, Homo sapiens
KLQEQLPEL

SEQ ID NO: 5747 - protein, 11 aa, Homo sapiens
KLQEVHPLLTL

SEQ ID NO: 5748 - protein, 9 aa, Homo sapiens
KLQEVLDYL

SEQ ID NO: 5749 - protein, 9 aa, Homo sapiens
KLQGKLPEL

SEQ ID NO: 5750 - protein, 9 aa, Homo sapiens
KLQKLLILL

SEQ ID NO: 5751 - protein, 9 aa, Homo sapiens
KLQLLLEEL

SEQ ID NO: 5752 - protein, 11 aa, Homo sapiens
KLQPTPGIQKV

SEQ ID NO: 5753 - protein, 9 aa, Homo sapiens
KLQQKVDEL

SEQ ID NO: 5754 - protein, 9 aa, Homo sapiens
KLQQLFIQL

SEQ ID NO: 5755 - protein, 9 aa, Homo sapiens
KLQQTLEEV

SEQ ID NO: 5756 - protein, 9 aa, Homo sapiens
KLRDSLELL

SEQ ID NO: 5757 - protein, 9 aa, Homo sapiens
KLRELVETL

SEQ ID NO: 5758 - protein, 9 aa, Homo sapiens
KLRSELEMV

SEQ ID NO: 5759 - protein, 9 aa, Homo sapiens
KLSDNILKL

SEQ ID NO: 5760 - protein, 9 aa, Homo sapiens
KLSDTLHSL

SEQ ID NO: 5761 - protein, 9 aa, Homo sapiens
KLSDVWKEL

SEQ ID NO: 5762 - protein, 9 aa, Homo sapiens
KLSDYEPKV

SEQ ID NO: 5763 - protein, 9 aa, Homo sapiens
KLSEEIMEI

SEQ ID NO: 5764 - protein, 11 aa, Homo sapiens
KLSEELSGGRL

SEQ ID NO: 5765 - protein, 9 aa, Homo sapiens
KLSEFDVEM

SEQ ID NO: 5766 - protein, 9 aa, Homo sapiens
KLSELQLRV

SEQ ID NO: 5767 - protein, 10 aa, Homo sapiens
KLSEQGLKEV

SEQ ID NO: 5768 - protein, 9 aa, Homo sapiens
KLSESQLEL

SEQ ID NO: 5769 - protein, 10 aa, Homo sapiens
KLSETHGYGV

SEQ ID NO: 5770 - protein, 9 aa, Homo sapiens
KLSEVAEAI

SEQ ID NO: 5771 - protein, 9 aa, Homo sapiens
KLSEVNKRL

SEQ ID NO: 5772 - protein, 9 aa, Homo sapiens
KLSEYEMSI

SEQ ID NO: 5773 - protein, 9 aa, Homo sapiens
KLSQVLNEL

SEQ ID NO: 5774 - protein, 9 aa, Homo sapiens
KLSQYLIQL

SEQ ID NO: 5775 - protein, 9 aa, Homo sapiens
KLSSLIILM

SEQ ID NO: 5776 - protein, 9 aa, Homo sapiens
KLTAATFTV

SEQ ID NO: 5777 - protein, 9 aa, Homo sapiens
KLTDFLPKL

SEQ ID NO: 5778 - protein, 10 aa, Homo sapiens
KLTDHGLEEI

SEQ ID NO: 5779 - protein, 10 aa, Homo sapiens
KLTDVGIATL

SEQ ID NO: 5780 - protein, 9 aa, Homo sapiens
KLTEGQYVL

SEQ ID NO: 5781 - protein, 9 aa, Homo sapiens
KLTEILELL

SEQ ID NO: 5782 - protein, 10 aa, Homo sapiens
KLTEMRGIYA

SEQ ID NO: 5783 - protein, 9 aa, Homo sapiens
KLTENLVAL

SEQ ID NO: 5784 - protein, 9 aa, Homo sapiens
KLTEVHEEL

SEQ ID NO: 5785 - protein, 9 aa, Homo sapiens
KLTEYVDKV

SEQ ID NO: 5786 - protein, 9 aa, Homo sapiens
KLTGILQEV

SEQ ID NO: 5787 - protein, 9 aa, Homo sapiens
KLTPLSHEV

SEQ ID NO: 5788 - protein, 9 aa, Homo sapiens
KLTVVLEAV

SEQ ID NO: 5789 - protein, 9 aa, Homo sapiens
KLVAHLEMI

SEQ ID NO: 5790 - protein, 9 aa, Homo sapiens
KLVDFVIHF

SEQ ID NO: 5791 - protein, 11 aa, Homo sapiens
KLVDPERDMSL

SEQ ID NO: 5792 - protein, 9 aa, Homo sapiens
KLVDPLYSI

SEQ ID NO: 5793 - protein, 9 aa, Homo sapiens
KLVDRTWTL

SEQ ID NO: 5794 - protein, 11 aa, Homo sapiens
KLVEIPTKMRV

SEQ ID NO: 5795 - protein, 9 aa, Homo sapiens
KLVGEFLEV

SEQ ID NO: 5796 - protein, 9 aa, Homo sapiens
KLVGMSVLL

SEQ ID NO: 5797 - protein, 9 aa, Homo sapiens
KLVHILNMV

SEQ ID NO: 5798 - protein, 9 aa, Homo sapiens
KLVNILVQL

SEQ ID NO: 5799 - protein, 9 aa, Homo sapiens
KLVNKVIEL

SEQ ID NO: 5800 - protein, 9 aa, Homo sapiens
KLVPFLKKV

SEQ ID NO: 5801 - protein, 9 aa, Homo sapiens
KLVPQLVRI

SEQ ID NO: 5802 - protein, 10 aa, Homo sapiens
KLVQEALEAV

SEQ ID NO: 5803 - protein, 9 aa, Homo sapiens
KLVQIEYAL

SEQ ID NO: 5804 - protein, 9 aa, Homo sapiens
KLVQILHRL

SEQ ID NO: 5805 - protein, 9 aa, Homo sapiens
KLVSLMVLL

SEQ ID NO: 5806 - protein, 9 aa, Homo sapiens
KLWADRISL

SEQ ID NO: 5807 - protein, 10 aa, Homo sapiens
KLWDEVLSHL

SEQ ID NO: 5808 - protein, 8 aa, Homo sapiens
KLWDINAH

SEQ ID NO: 5809 - protein, 9 aa, Homo sapiens
KLWDINAHI

SEQ ID NO: 5810 - protein, 11 aa, Homo sapiens
KLWDLEQQVKA

SEQ ID NO: 5811 - protein, 8 aa, Homo sapiens
KLWDVREG

SEQ ID NO: 5812 - protein, 10 aa, Homo sapiens
KLWEFFQVDV

SEQ ID NO: 5813 - protein, 11 aa, Homo sapiens
KLWEFPINNEA

SEQ ID NO: 5814 - protein, 11 aa, Homo sapiens
KLWEIPSLAYL

SEQ ID NO: 5815 - protein, 9 aa, Homo sapiens
KLWELLYKL

SEQ ID NO: 5816 - protein, 9 aa, Homo sapiens
KLWESPNVL

SEQ ID NO: 5817 - protein, 9 aa, Homo sapiens
KLWPLFVKL

SEQ ID NO: 5818 - protein, 11 aa, Homo sapiens
KLWTGGLDNTV

SEQ ID NO: 5819 - protein, 10 aa, Homo sapiens
KLWVGPVPMV

SEQ ID NO: 5820 - protein, 9 aa, Homo sapiens
KLYALDVLL

SEQ ID NO: 5821 - protein, 9 aa, Homo sapiens
KLYDDMIRL

SEQ ID NO: 5822 - protein, 10 aa, Homo sapiens
KLYEKLLTAV

SEQ ID NO: 5823 - protein, 9 aa, Homo sapiens
KLYELYLQL

SEQ ID NO: 5824 - protein, 9 aa, Homo sapiens
KLYESELTL

SEQ ID NO: 5825 - protein, 10 aa, Homo sapiens
KLYHQWLSTV

SEQ ID NO: 5826 - protein, 9 aa, Homo sapiens
KLYNIWIRL

SEQ ID NO: 5827 - protein, 9 aa, Homo sapiens
KLYNKELYA

SEQ ID NO: 5828 - protein, 9 aa, Homo sapiens
KLYPQLSSV

SEQ ID NO: 5829 - protein, 11 aa, Homo sapiens
KLYQEVEIASV

SEQ ID NO: 5830 - protein, 10 aa, Homo sapiens
KLYSSSGPEL

SEQ ID NO: 5831 - protein, 9 aa, Homo sapiens
KLYSVVSQL

SEQ ID NO: 5832 - protein, 10 aa, Homo sapiens
KLYTGLEYDL

SEQ ID NO: 5833 - protein, 9 aa, Homo sapiens
KMAPPPKEV

SEQ ID NO: 5834 - protein, 9 aa, Homo sapiens
KMFEFYERV

SEQ ID NO: 5835 - protein, 10 aa, Homo sapiens
KMFESFIESV

SEQ ID NO: 5836 - protein, 10 aa, Homo sapiens
KMHDYDGNNL

SEQ ID NO: 5837 - protein, 10 aa, Homo sapiens
KMISMDIEQV

SEQ ID NO: 5838 - protein, 11 aa, Homo sapiens
KMKQELEAEYL

SEQ ID NO: 5839 - protein, 10 aa, Homo sapiens
KMLDEILLQL

SEQ ID NO: 5840 - protein, 11 aa, Homo sapiens
KMLDHPHIIKL

SEQ ID NO: 5841 - protein, 10 aa, Homo sapiens
KMLEIDPQKV

SEQ ID NO: 5842 - protein, 9 aa, Homo sapiens
KMVSIQITL

SEQ ID NO: 5843 - protein, 11 aa, Homo sapiens
KMYEKIDLTLL

SEQ ID NO: 5844 - protein, 9 aa, Homo sapiens
KQFEGTVEI

SEQ ID NO: 5845 - protein, 9 aa, Homo sapiens
KQISTLESV

SEQ ID NO: 5846 - protein, 9 aa, Homo sapiens
KQLNHFWEI

SEQ ID NO: 5847 - protein, 9 aa, Homo sapiens
KQTDLEITV

SEQ ID NO: 5848 - protein, 9 aa, Homo sapiens
KQTDVAAEV

SEQ ID NO: 5849 - protein, 9 aa, Homo sapiens
KVADLVLML

SEQ ID NO: 5850 - protein, 9 aa, Homo sapiens
KVADTILFL

SEQ ID NO: 5851 - protein, 9 aa, Homo sapiens
KVASLLHQV

SEQ ID NO: 5852 - protein, 10 aa, Homo sapiens
KVFSGALQEA

SEQ ID NO: 5853 - protein, 9 aa, Homo sapiens
KVHEYNVLL

SEQ ID NO: 5854 - protein, 9 aa, Homo sapiens
KVLDVLWEL

SEQ ID NO: 5855 - protein, 9 aa, Homo sapiens
KVLGKIEKV

SEQ ID NO: 5856 - protein, 9 aa, Homo sapiens
KVLSKEFHL

SEQ ID NO: 5857 - protein, 9 aa, Homo sapiens
KVMGFGLYL

SEQ ID NO: 5858 - protein, 9 aa, Homo sapiens
KVQEQIFNL

SEQ ID NO: 5859 - protein, 11 aa, Homo sapiens
KVSEEAKSILL

SEQ ID NO: 5860 - protein, 9 aa, Homo sapiens
KYPHYFPLL

SEQ ID NO: 5861 - protein, 8 aa, Homo sapiens
LDKKVEKV

SEQ ID NO: 5862 - protein, 9 aa, Adeno-associated virus - 2
LIDQYLYYL

SEQ ID NO: 5863 - protein, 9 aa, Homo sapiens
LIDTSRHYL

SEQ ID NO: 5864 - protein, 9 aa, Homo sapiens
LIHKVWMEL

SEQ ID NO: 5865 - protein, 8 aa, Homo sapiens
LIQKLILL

SEQ ID NO: 5866 - protein, 8 aa, Homo sapiens
LIQSLVSI

SEQ ID NO: 5867 - protein, 9 aa, Homo sapiens
LIYSGKLLL

SEQ ID NO: 5868 - protein, 9 aa, Homo sapiens
LLADELITV

SEQ ID NO: 5869 - protein, 9 aa, Homo sapiens
LLADHTVHV

SEQ ID NO: 5870 - protein, 9 aa, Homo sapiens
LLADVETFV

SEQ ID NO: 5871 - protein, 10 aa, Homo sapiens
LLAEDDELHL

SEQ ID NO: 5872 - protein, 10 aa, Homo sapiens
LLAEIGAVTL

SEQ ID NO: 5873 - protein, 11 aa, Homo sapiens
LLAEIGAVTLV

SEQ ID NO: 5874 - protein, 9 aa, Homo sapiens
LLAEKVEEI

SEQ ID NO: 5875 - protein, 9 aa, Homo sapiens
LLAELLTHL

SEQ ID NO: 5876 - protein, 9 aa, Homo sapiens
LLAELPASV

SEQ ID NO: 5877 - protein, 11 aa, Homo sapiens
LLAELPASVHA

SEQ ID NO: 5878 - protein, 10 aa, Homo sapiens
LLAELREYNL

SEQ ID NO: 5879 - protein, 9 aa, Homo sapiens
LLAERDLYL

SEQ ID NO: 5880 - protein, 9 aa, Homo sapiens
LLAESVTEV

SEQ ID NO: 5881 - protein, 9 aa, Homo sapiens
LLAEVIENL

SEQ ID NO: 5882 - protein, 9 aa, Homo sapiens
LLAGLHVLL

SEQ ID NO: 5883 - protein, 9 aa, Homo sapiens
LLANTAAHI

SEQ ID NO: 5884 - protein, 9 aa, Homo sapiens
LLAPAPAQA

SEQ ID NO: 5885 - protein, 9 aa, Homo sapiens
LLAPPPPSA

SEQ ID NO: 5886 - protein, 11 aa, Homo sapiens
LLAPTPYIIGV

SEQ ID NO: 5887 - protein, 9 aa, Homo sapiens
LLAQGVAAA

SEQ ID NO: 5888 - protein, 9 aa, Homo sapiens
LLASKAVGV

SEQ ID NO: 5889 - protein, 9 aa, Homo sapiens
LLASYVHYV

SEQ ID NO: 5890 - protein, 9 aa, Homo sapiens
LLATEVVTV

SEQ ID NO: 5891 - protein, 9 aa, Homo sapiens
LLAVPVPGV

SEQ ID NO: 5892 - protein, 11 aa, Homo sapiens
LLCRPPPGALP

SEQ ID NO: 5893 - protein, 10 aa, Homo sapiens
LLDANLNIKI

SEQ ID NO: 5894 - protein, 10 aa, Homo sapiens
LLDDSLLPLA

SEQ ID NO: 5895 - protein, 9 aa, Homo sapiens
LLDDSLVSI

SEQ ID NO: 5896 - protein, 9 aa, Homo sapiens
LLDDTTVTL

SEQ ID NO: 5897 - protein, 9 aa, Homo sapiens
LLDEAIQAV

SEQ ID NO: 5898 - protein, 11 aa, Homo sapiens
LLDEFTTKLLA

SEQ ID NO: 5899 - protein, 10 aa, Homo sapiens
LLDEHGHVRI

SEQ ID NO: 5900 - protein, 11 aa, Homo sapiens
LLDEIENIKQV

SEQ ID NO: 5901 - protein, 9 aa, Homo sapiens
LLDELPQSV

SEQ ID NO: 5902 - protein, 9 aa, Homo sapiens
LLDERLVTL

SEQ ID NO: 5903 - protein, 9 aa, Homo sapiens
LLDLHSYLL

SEQ ID NO: 5904 - protein, 10 aa, Homo sapiens
LLDLIGAPNP

SEQ ID NO: 5905 - protein, 10 aa, Homo sapiens
LLDLLGAPNP

SEQ ID NO: 5906 - protein, 9 aa, Homo sapiens
LLDLRPSIL

SEQ ID NO: 5907 - protein, 9 aa, Homo sapiens
LLDNTDIHL

SEQ ID NO: 5908 - protein, 9 aa, Homo sapiens
LLDPTNPSA

SEQ ID NO: 5909 - protein, 9 aa, Homo sapiens
LLDPTNVFI

SEQ ID NO: 5910 - protein, 10 aa, Homo sapiens
LLDPVPPVLV

SEQ ID NO: 5911 - protein, 9 aa, Homo sapiens
LLDSIQLLP

SEQ ID NO: 5912 - protein, 10 aa, Homo sapiens
LLDSPGKVLL

SEQ ID NO: 5913 - protein, 9 aa, Homo sapiens
LLDTVTMQV

SEQ ID NO: 5914 - protein, 9 aa, Homo sapiens
LLEEINHFL

SEQ ID NO: 5915 - protein, 9 aa, Homo sapiens
LLELGDSLM

SEQ ID NO: 5916 - protein, 9 aa, Homo sapiens
LLETHSHFL

SEQ ID NO: 5917 - protein, 9 aa, Homo sapiens
LLFDEYHKL

SEQ ID NO: 5918 - protein, 11 aa, Homo sapiens
LLFDHLEPIEL

SEQ ID NO: 5919 - protein, 9 aa, Homo sapiens
LLFDVHTTL

SEQ ID NO: 5920 - protein, 11 aa, Homo sapiens
LLFEGEKKITI

SEQ ID NO: 5921 - protein, 10 aa, Homo sapiens
LLFGGSLARI

SEQ ID NO: 5922 - protein, 11 aa, Homo sapiens
LLFHHPNILEL

SEQ ID NO: 5923 - protein, 9 aa, Homo sapiens
LLFKEGVMV

SEQ ID NO: 5924 - protein, 11 aa, Homo sapiens
LLFPQIEGIKI

SEQ ID NO: 5925 - protein, 9 aa, Homo sapiens
LLGDLLFHI

SEQ ID NO: 5926 - protein, 9 aa, Homo sapiens
LLGEDQLVL

SEQ ID NO: 5927 - protein, 9 aa, Homo sapiens
LLGPKPFPL

SEQ ID NO: 5928 - protein, 9 aa, Homo sapiens
LLGSVVHEV

SEQ ID NO: 5929 - protein, 9 aa, Homo sapiens
LLGTLPIGA

SEQ ID NO: 5930 - protein, 9 aa, Homo sapiens
LLHDGIPVV

SEQ ID NO: 5931 - protein, 9 aa, Homo sapiens
LLHDKLFGL

SEQ ID NO: 5932 - protein, 9 aa, Homo sapiens
LLHDQIEKL

SEQ ID NO: 5933 - protein, 9 aa, Homo sapiens
LLHEKLYEL

SEQ ID NO: 5934 - protein, 9 aa, Homo sapiens
LLIDHRFLL

SEQ ID NO: 5935 - protein, 11 aa, Homo sapiens
LLIENVQRINV

SEQ ID NO: 5936 - protein, 11 aa, Homo sapiens
LLIGHLERVTV

SEQ ID NO: 5937 - protein, 10 aa, Homo sapiens
LLIIVIASSL

SEQ ID NO: 5938 - protein, 9 aa, Homo sapiens
LLIKLPELN

SEQ ID NO: 5939 - protein, 11 aa, Homo sapiens
LLINERGELKL

SEQ ID NO: 5940 - protein, 10 aa, Homo sapiens
LLINLVEYSA

SEQ ID NO: 5941 - protein, 9 aa, Homo sapiens
LLINSVFHV

SEQ ID NO: 5942 - protein, 9 aa, Homo sapiens
LLIPIHLEV

SEQ ID NO: 5943 - protein, 9 aa, Homo sapiens
LLIQTVEKA

SEQ ID NO: 5944 - protein, 9 aa, Homo sapiens
LLKDSIVQL

SEQ ID NO: 5945 - protein, 10 aa, Homo sapiens
LLKEGEEPTV

SEQ ID NO: 5946 - protein, 9 aa, Homo sapiens
LLKLAEETN

SEQ ID NO: 5947 - protein, 9 aa, Homo sapiens
LLKNLENLV

SEQ ID NO: 5948 - protein, 9 aa, Homo sapiens
LLKPDLILL

SEQ ID NO: 5949 - protein, 10 aa, Homo sapiens
LLKVVDLGNA

SEQ ID NO: 5950 - protein, 11 aa, Homo sapiens
LLLAHGADPTL

SEQ ID NO: 5951 - protein, 9 aa, Homo sapiens
LLLAHIIAL

SEQ ID NO: 5952 - protein, 9 aa, Homo sapiens
LLLAIIPHV

SEQ ID NO: 5953 - protein, 9 aa, Homo sapiens
LLLANTAAH

SEQ ID NO: 5954 - protein, 8 aa, Homo sapiens
LLLANVVV

SEQ ID NO: 5955 - protein, 11 aa, Homo sapiens
LLLASKQLGSP

SEQ ID NO: 5956 - protein, 9 aa, Homo sapiens
LLLDAKLLV

SEQ ID NO: 5957 - protein, 11 aa, Homo sapiens
LLLDENGVLKL

SEQ ID NO: 5958 - protein, 11 aa, Homo sapiens
LLLDGNMDIKL

SEQ ID NO: 5959 - protein, 9 aa, Homo sapiens
LLLDKLILL

SEQ ID NO: 5960 - protein, 9 aa, Homo sapiens
LLLDKPETV

SEQ ID NO: 5961 - protein, 10 aa, Homo sapiens
LLLDLGHLKV

SEQ ID NO: 5962 - protein, 10 aa, Homo sapiens
LLLDTVTMQV

SEQ ID NO: 5963 - protein, 9 aa, Homo sapiens
LLLEAVWHL

SEQ ID NO: 5964 - protein, 11 aa, Homo sapiens
LLLEEGGLVQV

SEQ ID NO: 5965 - protein, 9 aa, Homo sapiens
LLLESDPKV

SEQ ID NO: 5966 - protein, 9 aa, Homo sapiens
LLLEVVKQV

SEQ ID NO: 5967 - protein, 9 aa, Homo sapiens
LLLGQLVEV

SEQ ID NO: 5968 - protein, 9 aa, Homo sapiens
LLLKSLTYV

SEQ ID NO: 5969 - protein, 9 aa, Homo sapiens
LLLKYTEKL

SEQ ID NO: 5970 - protein, 9 aa, Homo sapiens
LLLLAHIIA

SEQ ID NO: 5971 - protein, 11 aa, Homo sapiens
LLLLDTVTMQV

SEQ ID NO: 5972 - protein, 10 aa, Homo sapiens
LLLLLQSCMS

SEQ ID NO: 5973 - protein, 9 aa, Homo sapiens
LLLNEDPLN

SEQ ID NO: 5974 - protein, 11 aa, Homo sapiens
LLLNEEALAQI

SEQ ID NO: 5975 - protein, 9 aa, Homo sapiens
LLLNYAVRL

SEQ ID NO: 5976 - protein, 9 aa, Homo sapiens
LLLPDAPLV

SEQ ID NO: 5977 - protein, 11 aa, Homo sapiens
LLLPDQPPYHL

SEQ ID NO: 5978 - protein, 9 aa, Homo sapiens
LLLPGSHYL

SEQ ID NO: 5979 - protein, 10 aa, Homo sapiens
LLLPGVIKTV

SEQ ID NO: 5980 - protein, 9 aa, Homo sapiens
LLLPLPLLL

SEQ ID NO: 5981 - protein, 9 aa, Homo sapiens
LLLQKETEL

SEQ ID NO: 5982 - protein, 9 aa, Homo sapiens
LLLSDLPGV

SEQ ID NO: 5983 - protein, 9 aa, Homo sapiens
LLLSGGLAL

SEQ ID NO: 5984 - protein, 9 aa, Homo sapiens
LLLSHLPLL

SEQ ID NO: 5985 - protein, 9 aa, Homo sapiens
LLLTENGIL

SEQ ID NO: 5986 - protein, 9 aa, Homo sapiens
LLLTKPTEA

SEQ ID NO: 5987 - protein, 9 aa, Homo sapiens
LLLTQRLPV

SEQ ID NO: 5988 - protein, 9 aa, Homo sapiens
LLLTTIPQI

SEQ ID NO: 5989 - protein, 9 aa, Homo sapiens
LLMDMLEKL

SEQ ID NO: 5990 - protein, 9 aa, Homo sapiens
LLMENAERV

SEQ ID NO: 5991 - protein, 10 aa, Homo sapiens
LLMIIGALTL

SEQ ID NO: 5992 - protein, 11 aa, Homo sapiens
LLMPIPEGLTL

SEQ ID NO: 5993 - protein, 11 aa, Homo sapiens
LLMPSSEDLLL

SEQ ID NO: 5994 - protein, 11 aa, Homo sapiens
LLMQPLSSIHV

SEQ ID NO: 5995 - protein, 9 aa, Homo sapiens
LLMQQVHTI

SEQ ID NO: 5996 - protein, 9 aa, Homo sapiens
LLMTDTHML

SEQ ID NO: 5997 - protein, 9 aa, Homo sapiens
LLNDHIYVV

SEQ ID NO: 5998 - protein, 9 aa, Homo sapiens
LLNDRKVFV

SEQ ID NO: 5999 - protein, 9 aa, Homo sapiens
LLNLAIVHA

SEQ ID NO: 6000 - protein, 8 aa, Homo sapiens
LLNSGVYL

SEQ ID NO: 6001 - protein, 9 aa, Homo sapiens
LLNSLFLIL

SEQ ID NO: 6002 - protein, 9 aa, Homo sapiens
LLNVEPAGA

SEQ ID NO: 6003 - protein, 10 aa, Homo sapiens
LLPDYYLVTV

SEQ ID NO: 6004 - protein, 9 aa, Homo sapiens
LLPEIMPGL

SEQ ID NO: 6005 - protein, 10 aa, Homo sapiens
LLPELRDWGV

SEQ ID NO: 6006 - protein, 9 aa, Homo sapiens
LLPEYLPYA

SEQ ID NO: 6007 - protein, 9 aa, Homo sapiens
LLPHILPLL

SEQ ID NO: 6008 - protein, 9 aa, Homo sapiens
LLPLKLLQL

SEQ ID NO: 6009 - protein, 9 aa, Homo sapiens
LLPPAPPHA

SEQ ID NO: 6010 - protein, 9 aa, Homo sapiens
LLPPAPPSV

SEQ ID NO: 6011 - protein, 9 aa, Homo sapiens
LLPPPPTSA

SEQ ID NO: 6012 - protein, 9 aa, Homo sapiens
LLQDGLKDL

SEQ ID NO: 6013 - protein, 9 aa, Homo sapiens
LLQDHPWLL

SEQ ID NO: 6014 - protein, 11 aa, Homo sapiens
LLQDIKLLENV

SEQ ID NO: 6015 - protein, 9 aa, Homo sapiens
LLQDRLVSV

SEQ ID NO: 6016 - protein, 10 aa, Homo sapiens
LLQEAGIKTA

SEQ ID NO: 6017 - protein, 9 aa, Homo sapiens
LLQEDLVHI

SEQ ID NO: 6018 - protein, 9 aa, Homo sapiens
LLQEHDIEL

SEQ ID NO: 6019 - protein, 9 aa, Homo sapiens
LLQESLAQA

SEQ ID NO: 6020 - protein, 9 aa, Homo sapiens
LLQGAELLL

SEQ ID NO: 6021 - protein, 8 aa, Homo sapiens
LLQHVLLL

SEQ ID NO: 6022 - protein, 9 aa, Homo sapiens
LLQLLKDNV

SEQ ID NO: 6023 - protein, 11 aa, Homo sapiens
LLQNGADPQLL

SEQ ID NO: 6024 - protein, 9 aa, Homo sapiens
LLQNNLPAV

SEQ ID NO: 6025 - protein, 11 aa, Homo sapiens
LLQPFADAMKL

SEQ ID NO: 6026 - protein, 9 aa, Homo sapiens
LLQPQPPLL

SEQ ID NO: 6027 - protein, 9 aa, Homo sapiens
LLRAAPLLL

SEQ ID NO: 6028 - protein, 9 aa, Homo sapiens
LLRAPGAEL

SEQ ID NO: 6029 - protein, 9 aa, Homo sapiens
LLRDGIELV

SEQ ID NO: 6030 - protein, 9 aa, Homo sapiens
LLREKVEFL

SEQ ID NO: 6031 - protein, 10 aa, Homo sapiens
LLSAAEPVPA

SEQ ID NO: 6032 - protein, 11 aa, Homo sapiens
LLSDLGSDIFA

SEQ ID NO: 6033 - protein, 8 aa, Homo sapiens
LLSDLHAF

SEQ ID NO: 6034 - protein, 9 aa, Homo sapiens
LLSDTKLEL

SEQ ID NO: 6035 - protein, 9 aa, Homo sapiens
LLSEIEEHL

SEQ ID NO: 6036 - protein, 9 aa, Homo sapiens
LLSEILHLL

SEQ ID NO: 6037 - protein, 9 aa, Homo sapiens
LLSELLEHL

SEQ ID NO: 6038 - protein, 11 aa, Homo sapiens
LLSEPSLLRTV

SEQ ID NO: 6039 - protein, 9 aa, Homo sapiens
LLSERFINV

SEQ ID NO: 6040 - protein, 9 aa, Homo sapiens
LLSESNERL

SEQ ID NO: 6041 - protein, 9 aa, Homo sapiens
LLSEVLAHL

SEQ ID NO: 6042 - protein, 10 aa, Homo sapiens
LLSHAGILKV

SEQ ID NO: 6043 - protein, 9 aa, Homo sapiens
LLSKVLIYL

SEQ ID NO: 6044 - protein, 10 aa, Homo sapiens
LLSLGGAIEI

SEQ ID NO: 6045 - protein, 8 aa, Homo sapiens
LLSLIRNW

SEQ ID NO: 6046 - protein, 9 aa, Homo sapiens
LLSNNNQAL

SEQ ID NO: 6047 - protein, 9 aa, Homo sapiens
LLSNWYHFL

SEQ ID NO: 6048 - protein, 11 aa, Homo sapiens
LLSPGGPGSTL

SEQ ID NO: 6049 - protein, 9 aa, Homo sapiens
LLSPHNPAL

SEQ ID NO: 6050 - protein, 9 aa, Homo sapiens
LLSQAQYHV

SEQ ID NO: 6051 - protein, 9 aa, Homo sapiens
LLSTLHLLV

SEQ ID NO: 6052 - protein, 9 aa, Homo sapiens
LLTDIKVKL

SEQ ID NO: 6053 - protein, 9 aa, Homo sapiens
LLTDILADV

SEQ ID NO: 6054 - protein, 9 aa, Homo sapiens
LLTDYILKV

SEQ ID NO: 6055 - protein, 9 aa, Homo sapiens
LLTEIRAVV

SEQ ID NO: 6056 - protein, 9 aa, Homo sapiens
LLTEQIHSL

SEQ ID NO: 6057 - protein, 9 aa, Homo sapiens
LLTKDLPAI

SEQ ID NO: 6058 - protein, 9 aa, Homo sapiens
LLTNVLETL

SEQ ID NO: 6059 - protein, 9 aa, Homo sapiens
LLVDEFLKV

SEQ ID NO: 6060 - protein, 11 aa, Homo sapiens
LLVDERSVAHV

SEQ ID NO: 6061 - protein, 9 aa, Homo sapiens
LLVDKEFKI

SEQ ID NO: 6062 - protein, 9 aa, Homo sapiens
LLVGFPLTV

SEQ ID NO: 6063 - protein, 9 aa, Homo sapiens
LLVGFVHYL

SEQ ID NO: 6064 - protein, 9 aa, Homo sapiens
LLVKYGADI

SEQ ID NO: 6065 - protein, 11 aa, Homo sapiens
LLVLSALPALL

SEQ ID NO: 6066 - protein, 9 aa, Homo sapiens
LLVNTLYTV

SEQ ID NO: 6067 - protein, 9 aa, Homo sapiens
LLWAGPVNA

SEQ ID NO: 6068 - protein, 9 aa, Homo sapiens
LLWDKIHKL

SEQ ID NO: 6069 - protein, 10 aa, Homo sapiens
LLWDVPAPSL

SEQ ID NO: 6070 - protein, 11 aa, Homo sapiens
LLWSPPDHMYL

SEQ ID NO: 6071 - protein, 9 aa, Homo sapiens
LLWWLQPRL

SEQ ID NO: 6072 - protein, 9 aa, Homo sapiens
LLYDQPLQV

SEQ ID NO: 6073 - protein, 10 aa, Homo sapiens
LLYEDIPDKV

SEQ ID NO: 6074 - protein, 10 aa, Homo sapiens
LLYEEGLRVV

SEQ ID NO: 6075 - protein, 9 aa, Homo sapiens
LLYEHQNNL

SEQ ID NO: 6076 - protein, 10 aa, Homo sapiens
LLYGGDLHSA

SEQ ID NO: 6077 - protein, 9 aa, Homo sapiens
LLYLLTHYL

SEQ ID NO: 6078 - protein, 10 aa, Homo sapiens
LLYNSTDPTL

SEQ ID NO: 6079 - protein, 9 aa, Homo sapiens
LMGPVVHEV

SEQ ID NO: 6080 - protein, 9 aa, Homo sapiens
LMNAVVQTV

SEQ ID NO: 6081 - protein, 9 aa, Homo sapiens
LMTDVLVFL

SEQ ID NO: 6082 - protein, 10 aa, Homo sapiens
LQDYIILPTI

SEQ ID NO: 6083 - protein, 9 aa, Homo sapiens
LQHEGIFRV

SEQ ID NO: 6084 - protein, 9 aa, Artificial Sequence
  unidentified
LTINKIYVI

SEQ ID NO: 6085 - protein, 8 aa, Artificial Sequence
  unidentified
MLEQVPAL

SEQ ID NO: 6086 - protein, 10 aa, Artificial Sequence
  unidentified
MLVLCASTEL

SEQ ID NO: 6087 - protein, 8 aa, Artificial Sequence
  unidentified
QLLLTLLG

SEQ ID NO: 6088 - protein, 9 aa, Artificial Sequence
  unidentified
SLSLSLSPL

SEQ ID NO: 6089 - protein, 8 aa, Homo sapiens
LQISAIIL

SEQ ID NO: 6090 - protein, 9 aa, Homo sapiens
LQWDKVLRL

SEQ ID NO: 6091 - protein, 9 aa, Homo sapiens
LSLDKLEAA

SEQ ID NO: 6092 - protein, 9 aa, Homo sapiens
LVDDNYFYL

SEQ ID NO: 6093 - protein, 9 aa, Homo sapiens
MITDVVPEV

SEQ ID NO: 6094 - protein, 9 aa, Homo sapiens
MIWKGLIVL

SEQ ID NO: 6095 - protein, 9 aa, Homo sapiens
MLADIPVTI

SEQ ID NO: 6096 - protein, 9 aa, Homo sapiens
MLADTVATL

SEQ ID NO: 6097 - protein, 10 aa, Homo sapiens
MLAEDAIKAA

SEQ ID NO: 6098 - protein, 9 aa, Homo sapiens
MLAEIEVLR

SEQ ID NO: 6099 - protein, 9 aa, Homo sapiens
MLAKHVITL

SEQ ID NO: 6100 - protein, 11 aa, Homo sapiens
MLALTSTLNKL

SEQ ID NO: 6101 - protein, 9 aa, Homo sapiens
MLAQETLQL

SEQ ID NO: 6102 - protein, 9 aa, Homo sapiens
MLAWINESL

SEQ ID NO: 6103 - protein, 9 aa, Homo sapiens
MLDDNNHLI

SEQ ID NO: 6104 - protein, 9 aa, Homo sapiens
MLDDRAYLV

SEQ ID NO: 6105 - protein, 9 aa, Homo sapiens
MLDKYSHYL

SEQ ID NO: 6106 - protein, 9 aa, Homo sapiens
MLEIYSNLL

SEQ ID NO: 6107 - protein, 11 aa, Homo sapiens
MLENMGIGIRN

SEQ ID NO: 6108 - protein, 9 aa, Homo sapiens
MLENYSLLL

SEQ ID NO: 6109 - protein, 9 aa, Homo sapiens
MLFDKFRSV

SEQ ID NO: 6110 - protein, 10 aa, Homo sapiens
MLFEEAFVHL

SEQ ID NO: 6111 - protein, 9 aa, Homo sapiens
MLFENMGAY

SEQ ID NO: 6112 - protein, 11 aa, Homo sapiens
MLFENMGAYTV

SEQ ID NO: 6113 - protein, 9 aa, Homo sapiens
MLFLGLHNV

SEQ ID NO: 6114 - protein, 9 aa, Homo sapiens
MLFSDSPFL

SEQ ID NO: 6115 - protein, 9 aa, Homo sapiens
MLFTGGYGL

SEQ ID NO: 6116 - protein, 11 aa, Homo sapiens
MLIEEGGLQHL

SEQ ID NO: 6117 - protein, 9 aa, Homo sapiens
MLIEKDPSL

SEQ ID NO: 6118 - protein, 9 aa, Homo sapiens
MLIEVIEKL

SEQ ID NO: 6119 - protein, 10 aa, Homo sapiens
MLKEEQEVAM

SEQ ID NO: 6120 - protein, 11 aa, Homo sapiens
MLKEEQEVAML

SEQ ID NO: 6121 - protein, 9 aa, Homo sapiens
MLKEIEEIL

SEQ ID NO: 6122 - protein, 10 aa, Homo sapiens
MLKLYNGLSE

SEQ ID NO: 6123 - protein, 10 aa, Homo sapiens
MLLCPDPAVS

SEQ ID NO: 6124 - protein, 9 aa, Homo sapiens
MLLDFIQHI

SEQ ID NO: 6125 - protein, 10 aa, Homo sapiens
MLLEGGPTTA

SEQ ID NO: 6126 - protein, 9 aa, Homo sapiens
MLLEHGITL

SEQ ID NO: 6127 - protein, 10 aa, Homo sapiens
MLLEIPYMAA

SEQ ID NO: 6128 - protein, 9 aa, Homo sapiens
MLLEKSFEL

SEQ ID NO: 6129 - protein, 9 aa, Homo sapiens
MLLIEDMTK

SEQ ID NO: 6130 - protein, 10 aa, Homo sapiens
MLLIQGLQIN

SEQ ID NO: 6131 - protein, 9 aa, Homo sapiens
MLLKGEILL

SEQ ID NO: 6132 - protein, 9 aa, Homo sapiens
MLLKTVLLL

SEQ ID NO: 6133 - protein, 9 aa, Homo sapiens
MLLMLFIFI

SEQ ID NO: 6134 - protein, 10 aa, Homo sapiens
MLLQTAVLQG

SEQ ID NO: 6135 - protein, 9 aa, Homo sapiens
MLLSKVEKL

SEQ ID NO: 6136 - protein, 9 aa, Homo sapiens
MLLTAVQLL

SEQ ID NO: 6137 - protein, 9 aa, Homo sapiens
MLLTKLPTI

SEQ ID NO: 6138 - protein, 8 aa, Homo sapiens
MLMVVLLV

SEQ ID NO: 6139 - protein, 9 aa, Homo sapiens
MLNFNVPHI

SEQ ID NO: 6140 - protein, 9 aa, Homo sapiens
MLNGQEVRL

SEQ ID NO: 6141 - protein, 9 aa, Homo sapiens
MLNIVKNEL

SEQ ID NO: 6142 - protein, 9 aa, Homo sapiens
MLPISNEPI

SEQ ID NO: 6143 - protein, 8 aa, Homo sapiens
MLPPCTTT

SEQ ID NO: 6144 - protein, 11 aa, Homo sapiens
MLQDSLEHVQL

SEQ ID NO: 6145 - protein, 9 aa, Homo sapiens
MLQFDELFK

SEQ ID NO: 6146 - protein, 9 aa, Homo sapiens
MLSEHTSKL

SEQ ID NO: 6147 - protein, 10 aa, Homo sapiens
MLSEKHLISV

SEQ ID NO: 6148 - protein, 9 aa, Homo sapiens
MLSPFISSV

SEQ ID NO: 6149 - protein, 9 aa, Homo sapiens
MLSQDAPTV

SEQ ID NO: 6150 - protein, 9 aa, Homo sapiens
MLTDLNTYL

SEQ ID NO: 6151 - protein, 9 aa, Homo sapiens
MLTDRIPWV

SEQ ID NO: 6152 - protein, 9 aa, Homo sapiens
MLTEIEHKV

SEQ ID NO: 6153 - protein, 9 aa, Homo sapiens
MLTGISPFL

SEQ ID NO: 6154 - protein, 9 aa, Homo sapiens
MLVNAVFYL

SEQ ID NO: 6155 - protein, 9 aa, Homo sapiens
MLVQGNWVV

SEQ ID NO: 6156 - protein, 9 aa, Homo sapiens
MLWKATIVL

SEQ ID NO: 6157 - protein, 9 aa, Homo sapiens
MLYEKLLTA

SEQ ID NO: 6158 - protein, 10 aa, Homo sapiens
MLYPEVIQQV

SEQ ID NO: 6159 - protein, 11 aa, Homo sapiens
MLYPGSVYLLQ

SEQ ID NO: 6160 - protein, 9 aa, Homo sapiens
MLYPKLISL

SEQ ID NO: 6161 - protein, 9 aa, Homo sapiens
MLYQTINSL

SEQ ID NO: 6162 - protein, 9 aa, Homo sapiens
MMLDDLLQL

SEQ ID NO: 6163 - protein, 11 aa, Homo sapiens
MQAPRAALVFA

SEQ ID NO: 6164 - protein, 8 aa, Homo sapiens
MSAELSWL

SEQ ID NO: 6165 - protein, 10 aa, Homo sapiens
MTAQAMSLSL

SEQ ID NO: 6166 - protein, 9 aa, Homo sapiens
MVDSKPVNL

SEQ ID NO: 6167 - protein, 9 aa, Homo sapiens
MVWVLGVII

SEQ ID NO: 6168 - protein, 11 aa, Homo sapiens
NIFPNPEATFV

SEQ ID NO: 6169 - protein, 10 aa, Homo sapiens
NILLGGLNLL

SEQ ID NO: 6170 - protein, 9 aa, Homo sapiens
NIMDFKLFL

SEQ ID NO: 6171 - protein, 9 aa, Homo sapiens
NIMDIKIGL

SEQ ID NO: 6172 - protein, 9 aa, Homo sapiens
NIWNINLQL

SEQ ID NO: 6173 - protein, 9 aa, Homo sapiens
NLAGVYSEV

SEQ ID NO: 6174 - protein, 9 aa, Homo sapiens
NLAIIITDV

SEQ ID NO: 6175 - protein, 11 aa, Homo sapiens
NLAPTDVLEAL

SEQ ID NO: 6176 - protein, 9 aa, Homo sapiens
NLARALQQV

SEQ ID NO: 6177 - protein, 9 aa, Homo sapiens
NLDFNPPHV

SEQ ID NO: 6178 - protein, 9 aa, Homo sapiens
NLDNPIQTV

SEQ ID NO: 6179 - protein, 9 aa, Homo sapiens
NLDPAALTL

SEQ ID NO: 6180 - protein, 9 aa, Homo sapiens
NLFAQTYGL

SEQ ID NO: 6181 - protein, 11 aa, Homo sapiens
NLFDISQSAQT

SEQ ID NO: 6182 - protein, 9 aa, Homo sapiens
NLFEWHFTV

SEQ ID NO: 6183 - protein, 9 aa, Homo sapiens
NLFKKVYLL

SEQ ID NO: 6184 - protein, 9 aa, Homo sapiens
NLFRAPIYL

SEQ ID NO: 6185 - protein, 9 aa, Homo sapiens
NLGILSTLL

SEQ ID NO: 6186 - protein, 9 aa, Homo sapiens
NLIANVLYL

SEQ ID NO: 6187 - protein, 8 aa, Homo sapiens
NLIDLDDL

SEQ ID NO: 6188 - protein, 9 aa, Homo sapiens
NLIEVNEEV

SEQ ID NO: 6189 - protein, 9 aa, Homo sapiens
NLIKELARV

SEQ ID NO: 6190 - protein, 9 aa, Homo sapiens
NLIPILKTV

SEQ ID NO: 6191 - protein, 9 aa, Homo sapiens
NLLAHIWAL

SEQ ID NO: 6192 - protein, 11 aa, Homo sapiens
NLLDLNQKLQL

SEQ ID NO: 6193 - protein, 11 aa, Homo sapiens
NLLDSKINTLL

SEQ ID NO: 6194 - protein, 11 aa, Homo sapiens
NLLDSNAVHHI

SEQ ID NO: 6195 - protein, 9 aa, Homo sapiens
NLLETKLQL

SEQ ID NO: 6196 - protein, 8 aa, Homo sapiens
NLLLTVQI

SEQ ID NO: 6197 - protein, 9 aa, Homo sapiens
NLLPHAINL

SEQ ID NO: 6198 - protein, 11 aa, Homo sapiens
NLLPYSLRYLL

SEQ ID NO: 6199 - protein, 9 aa, Homo sapiens
NLLRFIQEV

SEQ ID NO: 6200 - protein, 9 aa, Homo sapiens
NLLRRLWVV

SEQ ID NO: 6201 - protein, 9 aa, Homo sapiens
NLLYPVPLI

SEQ ID NO: 6202 - protein, 9 aa, Homo sapiens
NLMDIKIGL

SEQ ID NO: 6203 - protein, 9 aa, Homo sapiens
NLMEKLETL

SEQ ID NO: 6204 - protein, 9 aa, Homo sapiens
NLMEKTVEV

SEQ ID NO: 6205 - protein, 9 aa, Homo sapiens
NLMESLDSL

SEQ ID NO: 6206 - protein, 9 aa, Homo sapiens
NLNSIVPSV

SEQ ID NO: 6207 - protein, 11 aa, Homo sapiens
NLSETASTMAL

SEQ ID NO: 6208 - protein, 9 aa, Homo sapiens
NLTENLQYV

SEQ ID NO: 6209 - protein, 9 aa, Homo sapiens
NLTKIVAYL

SEQ ID NO: 6210 - protein, 9 aa, Homo sapiens
NLVPMIIHL

SEQ ID NO: 6211 - protein, 9 aa, Homo sapiens
NLVRELLAV

SEQ ID NO: 6212 - protein, 9 aa, Homo sapiens
NLWSLVAKV

SEQ ID NO: 6213 - protein, 9 aa, Homo sapiens
NLYAQMHGL

SEQ ID NO: 6214 - protein, 9 aa, Homo sapiens
NLYGLLHGL

SEQ ID NO: 6215 - protein, 9 aa, Homo sapiens
NLYGQPVAA

SEQ ID NO: 6216 - protein, 9 aa, Homo sapiens
NLYMHQVLI

SEQ ID NO: 6217 - protein, 11 aa, Homo sapiens
NMLDVNGLFTL

SEQ ID NO: 6218 - protein, 9 aa, Homo sapiens
NMLNLAVHL

SEQ ID NO: 6219 - protein, 9 aa, Homo sapiens
NMLPQIFRV

SEQ ID NO: 6220 - protein, 11 aa, Homo sapiens
NMYEGVGRMFI

SEQ ID NO: 6221 - protein, 9 aa, Homo sapiens
NQMPTQPQV

SEQ ID NO: 6222 - protein, 8 aa, Homo sapiens
NVAVIPTV

SEQ ID NO: 6223 - protein, 8 aa, Homo sapiens
NVVALVAV

SEQ ID NO: 6224 - protein, 11 aa, Homo sapiens
PLAAAAAAAAA

SEQ ID NO: 6225 - protein, 9 aa, Homo sapiens
PLEVSSVVI

SEQ ID NO: 6226 - protein, 9 aa, Homo sapiens
PLFICGEPI

SEQ ID NO: 6227 - protein, 9 aa, Homo sapiens
PLGPAPVSV

SEQ ID NO: 6228 - protein, 10 aa, Homo sapiens
PLGSTQDHAL

SEQ ID NO: 6229 - protein, 9 aa, Homo sapiens
PLLLAAAGL

SEQ ID NO: 6230 - protein, 8 aa, Homo sapiens
PLLLAPEN

SEQ ID NO: 6231 - protein, 9 aa, Homo sapiens
PLLYSIPEL

SEQ ID NO: 6232 - protein, 8 aa, Homo sapiens
PLQHRHVL

SEQ ID NO: 6233 - protein, 8 aa, Homo sapiens
PLRPLEFL

SEQ ID NO: 6234 - protein, 9 aa, Homo sapiens
PLSAARAAL

SEQ ID NO: 6235 - protein, 9 aa, Homo sapiens
PLSEVIVKN

SEQ ID NO: 6236 - protein, 8 aa, Homo sapiens
PLSMIVAI

SEQ ID NO: 6237 - protein, 9 aa, Homo sapiens
PLSPHLGPL

SEQ ID NO: 6238 - protein, 10 aa, Homo sapiens
PLSRSAPTTL

SEQ ID NO: 6239 - protein, 9 aa, Homo sapiens
PLSYLPTSL

SEQ ID NO: 6240 - protein, 9 aa, Homo sapiens
QILDGVHYL

SEQ ID NO: 6241 - protein, 10 aa, Homo sapiens
QLADDLKAQL

SEQ ID NO: 6242 - protein, 9 aa, Homo sapiens
QLAEDLKKV

SEQ ID NO: 6243 - protein, 9 aa, Homo sapiens
QLAESVANV

SEQ ID NO: 6244 - protein, 9 aa, Homo sapiens
QLAFHQFYI

SEQ ID NO: 6245 - protein, 9 aa, Homo sapiens
QLAGFPVTV

SEQ ID NO: 6246 - protein, 9 aa, Homo sapiens
QLAIGVNEV

SEQ ID NO: 6247 - protein, 10 aa, Homo sapiens
QLANEEIAQV

SEQ ID NO: 6248 - protein, 9 aa, Homo sapiens
QLCEPLPSL

SEQ ID NO: 6249 - protein, 10 aa, Homo sapiens
QLDEARGLLL

SEQ ID NO: 6250 - protein, 10 aa, Homo sapiens
QLDENANVQL

SEQ ID NO: 6251 - protein, 9 aa, Homo sapiens
QLENLVQEL

SEQ ID NO: 6252 - protein, 9 aa, Homo sapiens
QLFEKQLQL

SEQ ID NO: 6253 - protein, 10 aa, Homo sapiens
QLFGGQLGQI

SEQ ID NO: 6254 - protein, 9 aa, Homo sapiens
QLFLLDIAQ

SEQ ID NO: 6255 - protein, 9 aa, Homo sapiens
QLFSEIHNL

SEQ ID NO: 6256 - protein, 9 aa, Homo sapiens
QLFSQQHFL

SEQ ID NO: 6257 - protein, 9 aa, Homo sapiens
QLIDAVLNL

SEQ ID NO: 6258 - protein, 11 aa, Homo sapiens
QLIDIIHTAAA

SEQ ID NO: 6259 - protein, 9 aa, Homo sapiens
QLIDYERQL

SEQ ID NO: 6260 - protein, 9 aa, Homo sapiens
QLIERILEA

SEQ ID NO: 6261 - protein, 9 aa, Homo sapiens
QLIEVIEKL

SEQ ID NO: 6262 - protein, 9 aa, Homo sapiens
QLIPALAKV

SEQ ID NO: 6263 - protein, 9 aa, Homo sapiens
QLIRNLEEV

SEQ ID NO: 6264 - protein, 9 aa, Homo sapiens
QLISSNLEL

SEQ ID NO: 6265 - protein, 9 aa, Homo sapiens
QLKKQAEQL

SEQ ID NO: 6266 - protein, 9 aa, Homo sapiens
QLLAILPEA

SEQ ID NO: 6267 - protein, 9 aa, Homo sapiens
QLLDFERTL

SEQ ID NO: 6268 - protein, 9 aa, Homo sapiens
QLLDFSQKL

SEQ ID NO: 6269 - protein, 10 aa, Homo sapiens
QLLDGFMITL

SEQ ID NO: 6270 - protein, 10 aa, Homo sapiens
QLLEALLFRV

SEQ ID NO: 6271 - protein, 9 aa, Homo sapiens
QLLEEKDLL

SEQ ID NO: 6272 - protein, 9 aa, Homo sapiens
QLLELRKIL

SEQ ID NO: 6273 - protein, 9 aa, Homo sapiens
QLLERQPLL

SEQ ID NO: 6274 - protein, 11 aa, Homo sapiens
QLLKDAAAFLL

SEQ ID NO: 6275 - protein, 9 aa, Homo sapiens
QLLPLLEKV

SEQ ID NO: 6276 - protein, 9 aa, Homo sapiens
QLLQFETQV

SEQ ID NO: 6277 - protein, 10 aa, Homo sapiens
QLLQGSLPLE

SEQ ID NO: 6278 - protein, 9 aa, Homo sapiens
QLLQYVYNL

SEQ ID NO: 6279 - protein, 9 aa, Homo sapiens
QLLSHLHTL

SEQ ID NO: 6280 - protein, 9 aa, Homo sapiens
QLLTAIVKL

SEQ ID NO: 6281 - protein, 9 aa, Homo sapiens
QLLTGSPEL

SEQ ID NO: 6282 - protein, 9 aa, Homo sapiens
QLLTQIHLL

SEQ ID NO: 6283 - protein, 9 aa, Homo sapiens
QLNDVAHLV

SEQ ID NO: 6284 - protein, 9 aa, Homo sapiens
QLNEQLVTL

SEQ ID NO: 6285 - protein, 9 aa, Homo sapiens
QLPNFAFSV

SEQ ID NO: 6286 - protein, 9 aa, Homo sapiens
QLPSASTGI

SEQ ID NO: 6287 - protein, 10 aa, Homo sapiens
QLPTLLIAEC

SEQ ID NO: 6288 - protein, 9 aa, Homo sapiens
QLPYSLALL

SEQ ID NO: 6289 - protein, 9 aa, Homo sapiens
QLQDFDWQV

SEQ ID NO: 6290 - protein, 9 aa, Homo sapiens
QLQDRVYAL

SEQ ID NO: 6291 - protein, 11 aa, Homo sapiens
QLQDVHLLQSV

SEQ ID NO: 6292 - protein, 9 aa, Homo sapiens
QLQEELHQL

SEQ ID NO: 6293 - protein, 9 aa, Homo sapiens
QLQEENFRL

SEQ ID NO: 6294 - protein, 9 aa, Homo sapiens
QLQEETFRL

SEQ ID NO: 6295 - protein, 9 aa, Homo sapiens
QLQEKIKLE

SEQ ID NO: 6296 - protein, 9 aa, Homo sapiens
QLQKMVHDI

SEQ ID NO: 6297 - protein, 9 aa, Homo sapiens
QLRLPGQQL

SEQ ID NO: 6298 - protein, 9 aa, Homo sapiens
QLSEVFIQL

SEQ ID NO: 6299 - protein, 9 aa, Homo sapiens
QLSLLVEAQ

SEQ ID NO: 6300 - protein, 10 aa, Homo sapiens
QLSLSSRLQL

SEQ ID NO: 6301 - protein, 8 aa, Homo sapiens
QLTALLAA

SEQ ID NO: 6302 - protein, 9 aa, Homo sapiens
QLTDLNVQL

SEQ ID NO: 6303 - protein, 9 aa, Homo sapiens
QLTEIKPLL

SEQ ID NO: 6304 - protein, 9 aa, Homo sapiens
QLTRMAGAI

SEQ ID NO: 6305 - protein, 9 aa, Homo sapiens
QLTSNLAQV

SEQ ID NO: 6306 - protein, 11 aa, Homo sapiens
QLVAVEALIHA

SEQ ID NO: 6307 - protein, 9 aa, Homo sapiens
QLVDFQWKL

SEQ ID NO: 6308 - protein, 9 aa, Homo sapiens
QLVDTTVEL

SEQ ID NO: 6309 - protein, 9 aa, Homo sapiens
QLVEELLKI

SEQ ID NO: 6310 - protein, 9 aa, Homo sapiens
QLVEQVEQI

SEQ ID NO: 6311 - protein, 9 aa, Homo sapiens
QLVPALAKV

SEQ ID NO: 6312 - protein, 11 aa, Homo sapiens
QLVPVDIIESV

SEQ ID NO: 6313 - protein, 9 aa, Homo sapiens
QLVRDLLEV

SEQ ID NO: 6314 - protein, 9 aa, Homo sapiens
QLWNIFNQV

SEQ ID NO: 6315 - protein, 9 aa, Homo sapiens
QLYEFDIKV

SEQ ID NO: 6316 - protein, 9 aa, Homo sapiens
QLYQLFHYL

SEQ ID NO: 6317 - protein, 11 aa, Homo sapiens
QLYQRSGDMGL

SEQ ID NO: 6318 - protein, 10 aa, Homo sapiens
QLYRGLGGQL

SEQ ID NO: 6319 - protein, 9 aa, Homo sapiens
QMLELITRL

SEQ ID NO: 6320 - protein, 9 aa, Homo sapiens
QMLENQMEV

SEQ ID NO: 6321 - protein, 11 aa, Homo sapiens
QMLPLNTNIRL

SEQ ID NO: 6322 - protein, 9 aa, Homo sapiens
QMPETTETV

SEQ ID NO: 6323 - protein, 10 aa, Homo sapiens
QMPTLPPPSV

SEQ ID NO: 6324 - protein, 9 aa, Homo sapiens
QMVKELQEI

SEQ ID NO: 6325 - protein, 11 aa, Homo sapiens
QQLDSKFLEQV

SEQ ID NO: 6326 - protein, 9 aa, Homo sapiens
QTMSHLPQV

SEQ ID NO: 6327 - protein, 9 aa, Homo sapiens
RALPSIILL

SEQ ID NO: 6328 - protein, 11 aa, Homo sapiens
RIASWLPSFSV

SEQ ID NO: 6329 - protein, 9 aa, Homo sapiens
RIMEAIENV

SEQ ID NO: 6330 - protein, 9 aa, Homo sapiens
RLADALQEL

SEQ ID NO: 6331 - protein, 10 aa, Homo sapiens
RLADDLNEKI

SEQ ID NO: 6332 - protein, 10 aa, Homo sapiens
RLADLEALKV

SEQ ID NO: 6333 - protein, 9 aa, Homo sapiens
RLAEETEKL

SEQ ID NO: 6334 - protein, 9 aa, Homo sapiens
RLAELEEFI

SEQ ID NO: 6335 - protein, 9 aa, Homo sapiens
RLAELGLHL

SEQ ID NO: 6336 - protein, 9 aa, Homo sapiens
RLAELLVSV

SEQ ID NO: 6337 - protein, 9 aa, Homo sapiens
RLAELQEQL

SEQ ID NO: 6338 - protein, 11 aa, Homo sapiens
RLAETLAQIYL

SEQ ID NO: 6339 - protein, 9 aa, Homo sapiens
RLAETQEEI

SEQ ID NO: 6340 - protein, 9 aa, Homo sapiens
RLAEVEEKL

SEQ ID NO: 6341 - protein, 9 aa, Homo sapiens
RLAKELEEA

SEQ ID NO: 6342 - protein, 9 aa, Homo sapiens
RLALLKVLL

SEQ ID NO: 6343 - protein, 9 aa, Homo sapiens
RLANLLMLL

SEQ ID NO: 6344 - protein, 9 aa, Homo sapiens
RLANSISQV

SEQ ID NO: 6345 - protein, 9 aa, Homo sapiens
RLAPEIVSA

SEQ ID NO: 6346 - protein, 8 aa, Homo sapiens
RLAQAASL

SEQ ID NO: 6347 - protein, 9 aa, Homo sapiens
RLAQAMETA

SEQ ID NO: 6348 - protein, 10 aa, Homo sapiens
RLAQEGIYTL

SEQ ID NO: 6349 - protein, 9 aa, Homo sapiens
RLAQVSPEL

SEQ ID NO: 6350 - protein, 9 aa, Homo sapiens
RLASEIPVL

SEQ ID NO: 6351 - protein, 9 aa, Homo sapiens
RLASVAQEL

SEQ ID NO: 6352 - protein, 10 aa, Homo sapiens
RLEKKLNAFE

SEQ ID NO: 6353 - protein, 10 aa, Homo sapiens
RLFADILNDV

SEQ ID NO: 6354 - protein, 9 aa, Homo sapiens
RLFDDVPQV

SEQ ID NO: 6355 - protein, 11 aa, Homo sapiens
RLFDEGTISKW

SEQ ID NO: 6356 - protein, 9 aa, Homo sapiens
RLFDEPQLA

SEQ ID NO: 6357 - protein, 11 aa, Homo sapiens
RLFDTQSKEKL

SEQ ID NO: 6358 - protein, 9 aa, Homo sapiens
RLFDWLVSV

SEQ ID NO: 6359 - protein, 9 aa, Homo sapiens
RLFEGNALL

SEQ ID NO: 6360 - protein, 9 aa, Homo sapiens
RLFESINNL

SEQ ID NO: 6361 - protein, 10 aa, Homo sapiens
RLFGGLILDI

SEQ ID NO: 6362 - protein, 11 aa, Homo sapiens
RLFHDSAVTSV

SEQ ID NO: 6363 - protein, 10 aa, Homo sapiens
RLFPGLAIKI

SEQ ID NO: 6364 - protein, 9 aa, Homo sapiens
RLFQKTLKL

SEQ ID NO: 6365 - protein, 9 aa, Homo sapiens
RLFRDLVSL

SEQ ID NO: 6366 - protein, 10 aa, Homo sapiens
RLFSKSIETL

SEQ ID NO: 6367 - protein, 9 aa, Homo sapiens
RLGDAILSV

SEQ ID NO: 6368 - protein, 11 aa, Homo sapiens
RLGEKEILEKA

SEQ ID NO: 6369 - protein, 9 aa, Homo sapiens
RLGQLEGLL

SEQ ID NO: 6370 - protein, 10 aa, Homo sapiens
RLGSFHELLL

SEQ ID NO: 6371 - protein, 10 aa, Homo sapiens
RLHDLVLPLV

SEQ ID NO: 6372 - protein, 9 aa, Homo sapiens
RLHDVLMEL

SEQ ID NO: 6373 - protein, 9 aa, Homo sapiens
RLHEFDEQV

SEQ ID NO: 6374 - protein, 9 aa, Homo sapiens
RLHERLVAI

SEQ ID NO: 6375 - protein, 9 aa, Homo sapiens
RLHNTIVEI

SEQ ID NO: 6376 - protein, 9 aa, Homo sapiens
RLHQINIYL

SEQ ID NO: 6377 - protein, 8 aa, Homo sapiens
RLHSYVKA

SEQ ID NO: 6378 - protein, 9 aa, Homo sapiens
RLIALLEVL

SEQ ID NO: 6379 - protein, 9 aa, Homo sapiens
RLIALSFGL

SEQ ID NO: 6380 - protein, 11 aa, Homo sapiens
RLIDDEVRILI

SEQ ID NO: 6381 - protein, 9 aa, Homo sapiens
RLIDHLENT

SEQ ID NO: 6382 - protein, 9 aa, Homo sapiens
RLIEEENML

SEQ ID NO: 6383 - protein, 9 aa, Homo sapiens
RLIEESVTV

SEQ ID NO: 6384 - protein, 10 aa, Homo sapiens
RLIEVNGVDL

SEQ ID NO: 6385 - protein, 9 aa, Homo sapiens
RLIFHLVKV

SEQ ID NO: 6386 - protein, 10 aa, Homo sapiens
RLIGIKDMYA

SEQ ID NO: 6387 - protein, 10 aa, Homo sapiens
RLIKQILEGV

SEQ ID NO: 6388 - protein, 9 aa, Homo sapiens
RLISETTSV

SEQ ID NO: 6389 - protein, 10 aa, Homo sapiens
RLISQIVSSI

SEQ ID NO: 6390 - protein, 9 aa, Homo sapiens
RLISTLENL

SEQ ID NO: 6391 - protein, 9 aa, Homo sapiens
RLISVLEQI

SEQ ID NO: 6392 - protein, 9 aa, Homo sapiens
RLKEELEEA

SEQ ID NO: 6393 - protein, 9 aa, Homo sapiens
RLLAQVPGL

SEQ ID NO: 6394 - protein, 9 aa, Homo sapiens
RLLATIVML

SEQ ID NO: 6395 - protein, 9 aa, Homo sapiens
RLLAYISQV

SEQ ID NO: 6396 - protein, 9 aa, Homo sapiens
RLLDALEFL

SEQ ID NO: 6397 - protein, 11 aa, Homo sapiens
RLLDDNRELLV

SEQ ID NO: 6398 - protein, 9 aa, Homo sapiens
RLLDETLTL

SEQ ID NO: 6399 - protein, 11 aa, Homo sapiens
RLLDFPEAMVL

SEQ ID NO: 6400 - protein, 9 aa, Homo sapiens
RLLDFPTLL

SEQ ID NO: 6401 - protein, 10 aa, Homo sapiens
RLLDFPTLLV

SEQ ID NO: 6402 - protein, 11 aa, Homo sapiens
RLLDGGDFVSL

SEQ ID NO: 6403 - protein, 11 aa, Homo sapiens
RLLDKLVGEFL

SEQ ID NO: 6404 - protein, 11 aa, Homo sapiens
RLLDLDIPMSV

SEQ ID NO: 6405 - protein, 10 aa, Homo sapiens
RLLDLENSLL

SEQ ID NO: 6406 - protein, 10 aa, Homo sapiens
RLLDMGETDL

SEQ ID NO: 6407 - protein, 10 aa, Homo sapiens
RLLDSGAFHL

SEQ ID NO: 6408 - protein, 9 aa, Homo sapiens
RLLDTNPEI

SEQ ID NO: 6409 - protein, 11 aa, Homo sapiens
RLLDVDNRVVL

SEQ ID NO: 6410 - protein, 10 aa, Homo sapiens
RLLEEEGVSL

SEQ ID NO: 6411 - protein, 9 aa, Homo sapiens
RLLEELQRL

SEQ ID NO: 6412 - protein, 10 aa, Homo sapiens
RLLEEREVLL

SEQ ID NO: 6413 - protein, 10 aa, Homo sapiens
RLLEFELAQL

SEQ ID NO: 6414 - protein, 11 aa, Homo sapiens
RLLEIPAVSHV

SEQ ID NO: 6415 - protein, 9 aa, Homo sapiens
RLLELLTKL

SEQ ID NO: 6416 - protein, 9 aa, Homo sapiens
RLLENMTEV

SEQ ID NO: 6417 - protein, 10 aa, Homo sapiens
RLLENMTEVV

SEQ ID NO: 6418 - protein, 11 aa, Homo sapiens
RLLEPAQVQQL

SEQ ID NO: 6419 - protein, 11 aa, Homo sapiens
RLLESLDQLEL

SEQ ID NO: 6420 - protein, 9 aa, Homo sapiens
RLLESLIRL

SEQ ID NO: 6421 - protein, 10 aa, Homo sapiens
RLLGEEVVRV

SEQ ID NO: 6422 - protein, 9 aa, Homo sapiens
RLLGKLPEL

SEQ ID NO: 6423 - protein, 9 aa, Homo sapiens
RLLHEVQEL

SEQ ID NO: 6424 - protein, 9 aa, Homo sapiens
RLLLLVPLL

SEQ ID NO: 6425 - protein, 9 aa, Homo sapiens
RLLNFDTEL

SEQ ID NO: 6426 - protein, 9 aa, Homo sapiens
RLLNILMQL

SEQ ID NO: 6427 - protein, 9 aa, Homo sapiens
RLLPDIRGV

SEQ ID NO: 6428 - protein, 10 aa, Homo sapiens
RLLPEKLTIY

SEQ ID NO: 6429 - protein, 11 aa, Homo sapiens
RLLPELRDWGV

SEQ ID NO: 6430 - protein, 11 aa, Homo sapiens
RLLPGDIILKV

SEQ ID NO: 6431 - protein, 9 aa, Homo sapiens
RLLPKVQEV

SEQ ID NO: 6432 - protein, 11 aa, Homo sapiens
RLLPPELLRQL

SEQ ID NO: 6433 - protein, 9 aa, Homo sapiens
RLLSFVVLA

SEQ ID NO: 6434 - protein, 11 aa, Homo sapiens
RLMDDTSIAAA

SEQ ID NO: 6435 - protein, 9 aa, Homo sapiens
RLMEAMSEV

SEQ ID NO: 6436 - protein, 11 aa, Homo sapiens
RLMEDVEAEKL

SEQ ID NO: 6437 - protein, 11 aa, Homo sapiens
RLMEPIYLVEI

SEQ ID NO: 6438 - protein, 11 aa, Homo sapiens
RLMEPYYFVEV

SEQ ID NO: 6439 - protein, 10 aa, Homo sapiens
RLMEQQGALL

SEQ ID NO: 6440 - protein, 11 aa, Homo sapiens
RLMGLLSDPEL

SEQ ID NO: 6441 - protein, 9 aa, Homo sapiens
RLMKELEEI

SEQ ID NO: 6442 - protein, 9 aa, Homo sapiens
RLMKGEITL

SEQ ID NO: 6443 - protein, 10 aa, Homo sapiens
RLMQGDEICL

SEQ ID NO: 6444 - protein, 9 aa, Homo sapiens
RLNEIEAAL

SEQ ID NO: 6445 - protein, 11 aa, Homo sapiens
RLNEQASEEIL

SEQ ID NO: 6446 - protein, 9 aa, Homo sapiens
RLNPINTTL

SEQ ID NO: 6447 - protein, 9 aa, Homo sapiens
RLNPLVLLL

SEQ ID NO: 6448 - protein, 11 aa, Homo sapiens
RLPMSIIIVGV

SEQ ID NO: 6449 - protein, 11 aa, Homo sapiens
RLPPEGILHNV

SEQ ID NO: 6450 - protein, 11 aa, Homo sapiens
RLPPPFPGLEP

SEQ ID NO: 6451 - protein, 9 aa, Homo sapiens
RLQDLQQQV

SEQ ID NO: 6452 - protein, 9 aa, Homo sapiens
RLQEELEKL

SEQ ID NO: 6453 - protein, 10 aa, Homo sapiens
RLQEGDLPNA

SEQ ID NO: 6454 - protein, 9 aa, Homo sapiens
RLQELELQL

SEQ ID NO: 6455 - protein, 11 aa, Homo sapiens
RLQETEGMVAV

SEQ ID NO: 6456 - protein, 9 aa, Homo sapiens
RLQGELQAV

SEQ ID NO: 6457 - protein, 9 aa, Homo sapiens
RLQKELAEA

SEQ ID NO: 6458 - protein, 9 aa, Homo sapiens
RLQQELMTL

SEQ ID NO: 6459 - protein, 9 aa, Homo sapiens
RLQQTQAQV

SEQ ID NO: 6460 - protein, 10 aa, Homo sapiens
RLRATCTLSG

SEQ ID NO: 6461 - protein, 9 aa, Homo sapiens
RLSDFTESL

SEQ ID NO: 6462 - protein, 9 aa, Homo sapiens
RLSDQVLFV

SEQ ID NO: 6463 - protein, 11 aa, Homo sapiens
RLSEEASQALI

SEQ ID NO: 6464 - protein, 9 aa, Homo sapiens
RLSETDFKV

SEQ ID NO: 6465 - protein, 9 aa, Homo sapiens
RLSPYLEDV

SEQ ID NO: 6466 - protein, 9 aa, Homo sapiens
RLSSLLALL

SEQ ID NO: 6467 - protein, 9 aa, Homo sapiens
RLSSQLILL

SEQ ID NO: 6468 - protein, 9 aa, Homo sapiens
RLTELETAV

SEQ ID NO: 6469 - protein, 10 aa, Homo sapiens
RLTSLGVIGA

SEQ ID NO: 6470 - protein, 9 aa, Homo sapiens
RLTSLVPFV

SEQ ID NO: 6471 - protein, 9 aa, Homo sapiens
RLVESKVEL

SEQ ID NO: 6472 - protein, 10 aa, Homo sapiens
RLVEVNGENV

SEQ ID NO: 6473 - protein, 11 aa, Homo sapiens
RLVGDGVYGVP

SEQ ID NO: 6474 - protein, 9 aa, Homo sapiens
RLVGIMLLL

SEQ ID NO: 6475 - protein, 9 aa, Homo sapiens
RLVNYQISV

SEQ ID NO: 6476 - protein, 9 aa, Homo sapiens
RLVPSVNGV

SEQ ID NO: 6477 - protein, 9 aa, Homo sapiens
RLVSLITLL

SEQ ID NO: 6478 - protein, 11 aa, Homo sapiens
RLWDLTTGTTT

SEQ ID NO: 6479 - protein, 9 aa, Homo sapiens
RLWDWVPLA

SEQ ID NO: 6480 - protein, 9 aa, Homo sapiens
RLWEGAISI

SEQ ID NO: 6481 - protein, 9 aa, Homo sapiens
RLWEKLTLL

SEQ ID NO: 6482 - protein, 11 aa, Homo sapiens
RLWEQLVHFHV

SEQ ID NO: 6483 - protein, 11 aa, Homo sapiens
RLWGIPDQARV

SEQ ID NO: 6484 - protein, 10 aa, Homo sapiens
RLWNETVELF

SEQ ID NO: 6485 - protein, 8 aa, Homo sapiens
RLWQELSD

SEQ ID NO: 6486 - protein, 10 aa, Homo sapiens
RLYDRDVASA

SEQ ID NO: 6487 - protein, 10 aa, Homo sapiens
RLYDSILASL

SEQ ID NO: 6488 - protein, 9 aa, Homo sapiens
RLYDTHITV

SEQ ID NO: 6489 - protein, 9 aa, Homo sapiens
RLYETSYRL

SEQ ID NO: 6490 - protein, 9 aa, Homo sapiens
RLYGKDYNV

SEQ ID NO: 6491 - protein, 11 aa, Homo sapiens
RLYHEADKTYM

SEQ ID NO: 6492 - protein, 9 aa, Homo sapiens
RLYHITDQV

SEQ ID NO: 6493 - protein, 11 aa, Homo sapiens
RMATGLERMGA

SEQ ID NO: 6494 - protein, 9 aa, Homo sapiens
RMDELFVLI

SEQ ID NO: 6495 - protein, 11 aa, Homo sapiens
RMFDMGFEYQV

SEQ ID NO: 6496 - protein, 11 aa, Homo sapiens
RMLDSVEKLLV

SEQ ID NO: 6497 - protein, 11 aa, Homo sapiens
RMLEDRDLFVM

SEQ ID NO: 6498 - protein, 9 aa, Homo sapiens
RMNPNSPSI

SEQ ID NO: 6499 - protein, 9 aa, Homo sapiens
RMPSAGTTL

SEQ ID NO: 6500 - protein, 11 aa, Homo sapiens
RMTDQEAIQDL

SEQ ID NO: 6501 - protein, 9 aa, Homo sapiens
RQIDDILSV

SEQ ID NO: 6502 - protein, 9 aa, Homo sapiens
RQIEYEYKL

SEQ ID NO: 6503 - protein, 9 aa, Homo sapiens
RTLDFDPLL

SEQ ID NO: 6504 - protein, 9 aa, Homo sapiens
RVADRLYGV

SEQ ID NO: 6505 - protein, 9 aa, Homo sapiens
RVDEEPTTL

SEQ ID NO: 6506 - protein, 11 aa, Homo sapiens
RVIDYILDLQV

SEQ ID NO: 6507 - protein, 10 aa, Homo sapiens
RVLGPKIEAV

SEQ ID NO: 6508 - protein, 11 aa, Homo sapiens
RVMEELPLMLL

SEQ ID NO: 6509 - protein, 9 aa, Homo sapiens
RVMELFFTV

SEQ ID NO: 6510 - protein, 10 aa, Homo sapiens
SAIQILLTLL

SEQ ID NO: 6511 - protein, 9 aa, Homo sapiens
SIFEFVHAL

SEQ ID NO: 6512 - protein, 11 aa, Homo sapiens
SIFGEDALANV

SEQ ID NO: 6513 - protein, 8 aa, Homo sapiens
SIFKAWAV

SEQ ID NO: 6514 - protein, 9 aa, Homo sapiens
SIHDVTFQV

SEQ ID NO: 6515 - protein, 11 aa, Homo sapiens
SIKADEVLAEV

SEQ ID NO: 6516 - protein, 10 aa, Homo sapiens
SILDRDDIFV

SEQ ID NO: 6517 - protein, 11 aa, Homo sapiens
SILGNIENLKL

SEQ ID NO: 6518 - protein, 9 aa, Homo sapiens
SILKKVLEA

SEQ ID NO: 6519 - protein, 9 aa, Homo sapiens
SISLLLNFL

SEQ ID NO: 6520 - protein, 9 aa, Homo sapiens
SIYEYYHAL

SEQ ID NO: 6521 - protein, 10 aa, Homo sapiens
SLAAEESELR

SEQ ID NO: 6522 - protein, 9 aa, Homo sapiens
SLAAVEVLV

SEQ ID NO: 6523 - protein, 9 aa, Homo sapiens
SLAAVSQQL

SEQ ID NO: 6524 - protein, 9 aa, Homo sapiens
SLADFMQEV

SEQ ID NO: 6525 - protein, 9 aa, Homo sapiens
SLADVESQV

SEQ ID NO: 6526 - protein, 9 aa, Homo sapiens
SLADVEVVV

SEQ ID NO: 6527 - protein, 9 aa, Homo sapiens
SLADYITAA

SEQ ID NO: 6528 - protein, 9 aa, Homo sapiens
SLAEEHEGL

SEQ ID NO: 6529 - protein, 9 aa, Homo sapiens
SLAEFVQSL

SEQ ID NO: 6530 - protein, 10 aa, Homo sapiens
SLAEGSVTSV

SEQ ID NO: 6531 - protein, 11 aa, Homo sapiens
SLAELDEKISA

SEQ ID NO: 6532 - protein, 9 aa, Homo sapiens
SLAESLDQA

SEQ ID NO: 6533 - protein, 10 aa, Homo sapiens
SLAEVAGLQV

SEQ ID NO: 6534 - protein, 9 aa, Homo sapiens
SLAEVNTQL

SEQ ID NO: 6535 - protein, 9 aa, Homo sapiens
SLAEYIDMI

SEQ ID NO: 6536 - protein, 9 aa, Homo sapiens
SLAGNTYQL

SEQ ID NO: 6537 - protein, 9 aa, Homo sapiens
SLAGSLRSV

SEQ ID NO: 6538 - protein, 10 aa, Homo sapiens
SLAIIAANLS

SEQ ID NO: 6539 - protein, 9 aa, Homo sapiens
SLAMLLRLY

SEQ ID NO: 6540 - protein, 10 aa, Homo sapiens
SLAPAGIADA

SEQ ID NO: 6541 - protein, 9 aa, Homo sapiens
SLAPATPEV

SEQ ID NO: 6542 - protein, 11 aa, Homo sapiens
SLAPGDVVRQV

SEQ ID NO: 6543 - protein, 9 aa, Homo sapiens
SLAPPVTAV

SEQ ID NO: 6544 - protein, 9 aa, Homo sapiens
SLAPSITNV

SEQ ID NO: 6545 - protein, 9 aa, Homo sapiens
SLAQFEQKW

SEQ ID NO: 6546 - protein, 9 aa, Homo sapiens
SLAQVVMKV

SEQ ID NO: 6547 - protein, 9 aa, Homo sapiens
SLASQVVKL

SEQ ID NO: 6548 - protein, 9 aa, Homo sapiens
SLATPVVSV

SEQ ID NO: 6549 - protein, 11 aa, Homo sapiens
SLAVLGGKLYV

SEQ ID NO: 6550 - protein, 9 aa, Homo sapiens
SLCHVLPDL

SEQ ID NO: 6551 - protein, 10 aa, Homo sapiens
SLDDLTNLVV

SEQ ID NO: 6552 - protein, 9 aa, Homo sapiens
SLDDSISAA

SEQ ID NO: 6553 - protein, 9 aa, Homo sapiens
SLDEGIEQV

SEQ ID NO: 6554 - protein, 9 aa, Homo sapiens
SLDERPVAV

SEQ ID NO: 6555 - protein, 9 aa, Homo sapiens
SLDHKLAEV

SEQ ID NO: 6556 - protein, 10 aa, Homo sapiens
SLDPHAQVAV

SEQ ID NO: 6557 - protein, 9 aa, Homo sapiens
SLDQHVAAV

SEQ ID NO: 6558 - protein, 9 aa, Homo sapiens
SLDQKTPEA

SEQ ID NO: 6559 - protein, 9 aa, Homo sapiens
SLDRPHTVL

SEQ ID NO: 6560 - protein, 9 aa, Homo sapiens
SLEELLHYV

SEQ ID NO: 6561 - protein, 9 aa, Homo sapiens
SLFDARVHL

SEQ ID NO: 6562 - protein, 9 aa, Homo sapiens
SLFDLNFQA

SEQ ID NO: 6563 - protein, 9 aa, Homo sapiens
SLFDWNVKL

SEQ ID NO: 6564 - protein, 11 aa, Homo sapiens
SLFEDSDLLHA

SEQ ID NO: 6565 - protein, 9 aa, Homo sapiens
SLFEEMLQV

SEQ ID NO: 6566 - protein, 10 aa, Homo sapiens
SLFEGKALGL

SEQ ID NO: 6567 - protein, 11 aa, Homo sapiens
SLFGNIKGATI

SEQ ID NO: 6568 - protein, 10 aa, Homo sapiens
SLFGQDVKAV

SEQ ID NO: 6569 - protein, 10 aa, Homo sapiens
SLFGSPPTSV

SEQ ID NO: 6570 - protein, 9 aa, Homo sapiens
SLFKDQMEL

SEQ ID NO: 6571 - protein, 9 aa, Homo sapiens
SLFKELQEA

SEQ ID NO: 6572 - protein, 8 aa, Homo sapiens
SLFKIWLV

SEQ ID NO: 6573 - protein, 9 aa, Homo sapiens
SLFKLIVKV

SEQ ID NO: 6574 - protein, 9 aa, Homo sapiens
SLFPAELAL

SEQ ID NO: 6575 - protein, 9 aa, Homo sapiens
SLFPGQVVI

SEQ ID NO: 6576 - protein, 11 aa, Homo sapiens
SLFQGVEFHYV

SEQ ID NO: 6577 - protein, 9 aa, Homo sapiens
SLFQLAFLV

SEQ ID NO: 6578 - protein, 11 aa, Homo sapiens
SLFSDKQMIKL

SEQ ID NO: 6579 - protein, 11 aa, Homo sapiens
SLFSEETPVVL

SEQ ID NO: 6580 - protein, 10 aa, Homo sapiens
SLFSHSLISI

SEQ ID NO: 6581 - protein, 9 aa, Homo sapiens
SLFSMLHQA

SEQ ID NO: 6582 - protein, 9 aa, Homo sapiens
SLFSSPPEI

SEQ ID NO: 6583 - protein, 9 aa, Homo sapiens
SLFSVIVRV

SEQ ID NO: 6584 - protein, 9 aa, Homo sapiens
SLFSVLVRV

SEQ ID NO: 6585 - protein, 9 aa, Homo sapiens
SLGEEQFSV

SEQ ID NO: 6586 - protein, 9 aa, Homo sapiens
SLGEFHVRL

SEQ ID NO: 6587 - protein, 11 aa, Homo sapiens
SLGPSLATDKS

SEQ ID NO: 6588 - protein, 9 aa, Homo sapiens
SLHDISTEM

SEQ ID NO: 6589 - protein, 9 aa, Homo sapiens
SLHDRIYVI

SEQ ID NO: 6590 - protein, 9 aa, Homo sapiens
SLHEFLVNL

SEQ ID NO: 6591 - protein, 9 aa, Homo sapiens
SLHLHVPSV

SEQ ID NO: 6592 - protein, 9 aa, Homo sapiens
SLHSVIIQL

SEQ ID NO: 6593 - protein, 11 aa, Homo sapiens
SLIDDNNEINL

SEQ ID NO: 6594 - protein, 9 aa, Homo sapiens
SLIDKLYNI

SEQ ID NO: 6595 - protein, 11 aa, Homo sapiens
SLIDMRGIETV

SEQ ID NO: 6596 - protein, 9 aa, Homo sapiens
SLIDRTIKM

SEQ ID NO: 6597 - protein, 9 aa, Homo sapiens
SLIEHLQGL

SEQ ID NO: 6598 - protein, 9 aa, Homo sapiens
SLIEKPPIL

SEQ ID NO: 6599 - protein, 9 aa, Homo sapiens
SLIEKVTQL

SEQ ID NO: 6600 - protein, 9 aa, Homo sapiens
SLIERDLKL

SEQ ID NO: 6601 - protein, 9 aa, Homo sapiens
SLIERLYEI

SEQ ID NO: 6602 - protein, 9 aa, Homo sapiens
SLIFKLEEL

SEQ ID NO: 6603 - protein, 9 aa, Homo sapiens
SLIKQSAQL

SEQ ID NO: 6604 - protein, 9 aa, Homo sapiens
SLINFRVLL

SEQ ID NO: 6605 - protein, 11 aa, Homo sapiens
SLINVNDLSFV

SEQ ID NO: 6606 - protein, 9 aa, Homo sapiens
SLIPIISGV

SEQ ID NO: 6607 - protein, 9 aa, Homo sapiens
SLIQHLEEI

SEQ ID NO: 6608 - protein, 9 aa, Homo sapiens
SLIQKVDMV

SEQ ID NO: 6609 - protein, 9 aa, Homo sapiens
SLIRIVPVV

SEQ ID NO: 6610 - protein, 9 aa, Homo sapiens
SLISNPPAM

SEQ ID NO: 6611 - protein, 9 aa, Homo sapiens
SLITDLQTI

SEQ ID NO: 6612 - protein, 9 aa, Homo sapiens
SLITLIEKV

SEQ ID NO: 6613 - protein, 9 aa, Homo sapiens
SLKTPGTSL

SEQ ID NO: 6614 - protein, 9 aa, Homo sapiens
SLLAELEAI

SEQ ID NO: 6615 - protein, 9 aa, Homo sapiens
SLLASDHHL

SEQ ID NO: 6616 - protein, 10 aa, Homo sapiens
SLLDADIHSA

SEQ ID NO: 6617 - protein, 9 aa, Homo sapiens
SLLDCTFRL

SEQ ID NO: 6618 - protein, 11 aa, Homo sapiens
SLLDDSSLHLW

SEQ ID NO: 6619 - protein, 10 aa, Homo sapiens
SLLDEAIEAV

SEQ ID NO: 6620 - protein, 9 aa, Homo sapiens
SLLDEVLNV

SEQ ID NO: 6621 - protein, 9 aa, Homo sapiens
SLLDFERSL

SEQ ID NO: 6622 - protein, 11 aa, Homo sapiens
SLLDIIEKVMA

SEQ ID NO: 6623 - protein, 9 aa, Homo sapiens
SLLDLEQKL

SEQ ID NO: 6624 - protein, 10 aa, Homo sapiens
SLLDLGEVAL

SEQ ID NO: 6625 - protein, 9 aa, Homo sapiens
SLLDLPLSL

SEQ ID NO: 6626 - protein, 10 aa, Homo sapiens
SLLDMSLVKL

SEQ ID NO: 6627 - protein, 9 aa, Homo sapiens
SLLDPLPTA

SEQ ID NO: 6628 - protein, 9 aa, Homo sapiens
SLLDQIPEM

SEQ ID NO: 6629 - protein, 9 aa, Homo sapiens
SLLDVAVHM

SEQ ID NO: 6630 - protein, 9 aa, Homo sapiens
SLLEALDTI

SEQ ID NO: 6631 - protein, 9 aa, Homo sapiens
SLLEDLSHI

SEQ ID NO: 6632 - protein, 11 aa, Homo sapiens
SLLEEKLLPVL

SEQ ID NO: 6633 - protein, 9 aa, Homo sapiens
SLLEEKLVL

SEQ ID NO: 6634 - protein, 9 aa, Homo sapiens
SLLEILNSA

SEQ ID NO: 6635 - protein, 10 aa, Homo sapiens
SLLEKAGPEL

SEQ ID NO: 6636 - protein, 9 aa, Homo sapiens
SLLEKLSAL

SEQ ID NO: 6637 - protein, 9 aa, Homo sapiens
SLLEQLALE

SEQ ID NO: 6638 - protein, 10 aa, Homo sapiens
SLLERGLEAA

SEQ ID NO: 6639 - protein, 9 aa, Homo sapiens
SLLERLEKI

SEQ ID NO: 6640 - protein, 11 aa, Homo sapiens
SLLESSRSQEL

SEQ ID NO: 6641 - protein, 11 aa, Homo sapiens
SLLETGSDLLL

SEQ ID NO: 6642 - protein, 9 aa, Homo sapiens
SLLEYQMLV

SEQ ID NO: 6643 - protein, 10 aa, Homo sapiens
SLLGDMEWRL

SEQ ID NO: 6644 - protein, 9 aa, Homo sapiens
SLLGFVYKL

SEQ ID NO: 6645 - protein, 9 aa, Homo sapiens
SLLGHVIRL

SEQ ID NO: 6646 - protein, 10 aa, Homo sapiens
SLLGPPPVGV

SEQ ID NO: 6647 - protein, 9 aa, Homo sapiens
SLLGRSLEL

SEQ ID NO: 6648 - protein, 9 aa, Homo sapiens
SLLHVEQEV

SEQ ID NO: 6649 - protein, 9 aa, Homo sapiens
SLLKDLAEI

SEQ ID NO: 6650 - protein, 9 aa, Homo sapiens
SLLKEGYQL

SEQ ID NO: 6651 - protein, 9 aa, Homo sapiens
SLLLIPIHL

SEQ ID NO: 6652 - protein, 9 aa, Homo sapiens
SLLMSIHNI

SEQ ID NO: 6653 - protein, 9 aa, Homo sapiens
SLLNEIESI

SEQ ID NO: 6654 - protein, 9 aa, Homo sapiens
SLLNEIESV

SEQ ID NO: 6655 - protein, 10 aa, Homo sapiens
SLLNFVMPHM

SEQ ID NO: 6656 - protein, 9 aa, Homo sapiens
SLLNHLPYL

SEQ ID NO: 6657 - protein, 11 aa, Homo sapiens
SLLNPPETLNL

SEQ ID NO: 6658 - protein, 11 aa, Homo sapiens
SLLNQDLHWSL

SEQ ID NO: 6659 - protein, 9 aa, Homo sapiens
SLLNQPKAV

SEQ ID NO: 6660 - protein, 9 aa, Homo sapiens
SLLNTLAQI

SEQ ID NO: 6661 - protein, 10 aa, Homo sapiens
SLLPASLASI

SEQ ID NO: 6662 - protein, 11 aa, Homo sapiens
SLLPEYVVPYM

SEQ ID NO: 6663 - protein, 10 aa, Homo sapiens
SLLPGKLPTL

SEQ ID NO: 6664 - protein, 11 aa, Homo sapiens
SLLPGNLVEKV

SEQ ID NO: 6665 - protein, 11 aa, Homo sapiens
SLLPLASDPLL

SEQ ID NO: 6666 - protein, 11 aa, Homo sapiens
SLLPLDDIVRV

SEQ ID NO: 6667 - protein, 9 aa, Homo sapiens
SLLPLSHLV

SEQ ID NO: 6668 - protein, 9 aa, Homo sapiens
SLLPLVWKI

SEQ ID NO: 6669 - protein, 9 aa, Homo sapiens
SLLPQLTGA

SEQ ID NO: 6670 - protein, 11 aa, Homo sapiens
SLLPVDIRQYL

SEQ ID NO: 6671 - protein, 9 aa, Homo sapiens
SLLQALNEV

SEQ ID NO: 6672 - protein, 9 aa, Homo sapiens
SLLQHLIGL

SEQ ID NO: 6673 - protein, 9 aa, Homo sapiens
SLLQHVLLL

SEQ ID NO: 6674 - protein, 9 aa, Homo sapiens
SLLQQGEQL

SEQ ID NO: 6675 - protein, 9 aa, Homo sapiens
SLLQQLENV

SEQ ID NO: 6676 - protein, 11 aa, Homo sapiens
SLLSGALAGAL

SEQ ID NO: 6677 - protein, 9 aa, Homo sapiens
SLLSGLVRL

SEQ ID NO: 6678 - protein, 10 aa, Homo sapiens
SLLSGRISTL

SEQ ID NO: 6679 - protein, 9 aa, Homo sapiens
SLLSHDPRL

SEQ ID NO: 6680 - protein, 9 aa, Homo sapiens
SLLSSVFKL

SEQ ID NO: 6681 - protein, 11 aa, Homo sapiens
SLLSTDALPSA

SEQ ID NO: 6682 - protein, 9 aa, Homo sapiens
SLLSVSHAL

SEQ ID NO: 6683 - protein, 9 aa, Homo sapiens
SLLTAIHMV

SEQ ID NO: 6684 - protein, 9 aa, Homo sapiens
SLLTHIQNL

SEQ ID NO: 6685 - protein, 9 aa, Homo sapiens
SLLTSPPKA

SEQ ID NO: 6686 - protein, 9 aa, Homo sapiens
SLLTVIEKL

SEQ ID NO: 6687 - protein, 9 aa, Homo sapiens
SLLVHNVSV

SEQ ID NO: 6688 - protein, 9 aa, Homo sapiens
SLLYKVPYV

SEQ ID NO: 6689 - protein, 9 aa, Homo sapiens
SLMDDYLGL

SEQ ID NO: 6690 - protein, 9 aa, Homo sapiens
SLMDLQERL

SEQ ID NO: 6691 - protein, 9 aa, Homo sapiens
SLMDPDTKL

SEQ ID NO: 6692 - protein, 10 aa, Homo sapiens
SLMDPPGTAL

SEQ ID NO: 6693 - protein, 10 aa, Homo sapiens
SLMEDQVLQL

SEQ ID NO: 6694 - protein, 10 aa, Homo sapiens
SLMEEHGATL

SEQ ID NO: 6695 - protein, 11 aa, Homo sapiens
SLMEESGICKV

SEQ ID NO: 6696 - protein, 9 aa, Homo sapiens
SLMEKNQSL

SEQ ID NO: 6697 - protein, 11 aa, Homo sapiens
SLMEQLRGEAL

SEQ ID NO: 6698 - protein, 9 aa, Homo sapiens
SLMHVPPSL

SEQ ID NO: 6699 - protein, 9 aa, Homo sapiens
SLMNQNAQL

SEQ ID NO: 6700 - protein, 11 aa, Homo sapiens
SLMPHFKSMYL

SEQ ID NO: 6701 - protein, 9 aa, Homo sapiens
SLNELRVLL

SEQ ID NO: 6702 - protein, 9 aa, Homo sapiens
SLNEYQPKL

SEQ ID NO: 6703 - protein, 9 aa, Homo sapiens
SLNHLLNYV

SEQ ID NO: 6704 - protein, 9 aa, Homo sapiens
SLNKQIETV

SEQ ID NO: 6705 - protein, 9 aa, Homo sapiens
SLNKWIFTV

SEQ ID NO: 6706 - protein, 9 aa, Homo sapiens
SLNLAPPTV

SEQ ID NO: 6707 - protein, 9 aa, Homo sapiens
SLPELVHAV

SEQ ID NO: 6708 - protein, 9 aa, Homo sapiens
SLPENTVQV

SEQ ID NO: 6709 - protein, 11 aa, Homo sapiens
SLPESTLLQAV

SEQ ID NO: 6710 - protein, 11 aa, Homo sapiens
SLPGHAPGLSL

SEQ ID NO: 6711 - protein, 9 aa, Homo sapiens
SLPQNFANV

SEQ ID NO: 6712 - protein, 9 aa, Homo sapiens
SLPRFQVTL

SEQ ID NO: 6713 - protein, 9 aa, Homo sapiens
SLPRLLKVN

SEQ ID NO: 6714 - protein, 9 aa, Homo sapiens
SLPVITVSL

SEQ ID NO: 6715 - protein, 9 aa, Homo sapiens
SLQDHIEKI

SEQ ID NO: 6716 - protein, 9 aa, Homo sapiens
SLQDKAAEV

SEQ ID NO: 6717 - protein, 9 aa, Homo sapiens
SLQDLIEKV

SEQ ID NO: 6718 - protein, 11 aa, Homo sapiens
SLQDVVKGLFV

SEQ ID NO: 6719 - protein, 9 aa, Homo sapiens
SLQEAVQAA

SEQ ID NO: 6720 - protein, 9 aa, Homo sapiens
SLQEEQQQL

SEQ ID NO: 6721 - protein, 11 aa, Homo sapiens
SLQEFVKAFYL

SEQ ID NO: 6722 - protein, 9 aa, Homo sapiens
SLQEKPMEI

SEQ ID NO: 6723 - protein, 9 aa, Homo sapiens
SLQETIQSL

SEQ ID NO: 6724 - protein, 9 aa, Homo sapiens
SLQEVAMFL

SEQ ID NO: 6725 - protein, 9 aa, Homo sapiens
SLQNHQFEL

SEQ ID NO: 6726 - protein, 10 aa, Homo sapiens
SLQQALGKAE

SEQ ID NO: 6727 - protein, 9 aa, Homo sapiens
SLQQQLIHV

SEQ ID NO: 6728 - protein, 9 aa, Homo sapiens
SLQQRLEYI

SEQ ID NO: 6729 - protein, 9 aa, Homo sapiens
SLQVDNSLI

SEQ ID NO: 6730 - protein, 9 aa, Homo sapiens
SLREQLEGV

SEQ ID NO: 6731 - protein, 9 aa, Homo sapiens
SLRPQVSSI

SEQ ID NO: 6732 - protein, 9 aa, Homo sapiens
SLSDVTSTT

SEQ ID NO: 6733 - protein, 9 aa, Homo sapiens
SLSETNKGL

SEQ ID NO: 6734 - protein, 9 aa, Homo sapiens
SLSEYVSRM

SEQ ID NO: 6735 - protein, 9 aa, Homo sapiens
SLSGELREV

SEQ ID NO: 6736 - protein, 8 aa, Homo sapiens
SLSIVHSW

SEQ ID NO: 6737 - protein, 9 aa, Homo sapiens
SLSKITTTV

SEQ ID NO: 6738 - protein, 9 aa, Homo sapiens
SLSLAAMIR

SEQ ID NO: 6739 - protein, 9 aa, Homo sapiens
SLSNFIESV

SEQ ID NO: 6740 - protein, 10 aa, Homo sapiens
SLSPGALIAL

SEQ ID NO: 6741 - protein, 9 aa, Homo sapiens
SLSPTLVLN

SEQ ID NO: 6742 - protein, 10 aa, Homo sapiens
SLSQPPLQLR

SEQ ID NO: 6743 - protein, 9 aa, Homo sapiens
SLSQVFLHL

SEQ ID NO: 6744 - protein, 9 aa, Homo sapiens
SLSSVLSHV

SEQ ID NO: 6745 - protein, 11 aa, Homo sapiens
SLSTSVELPIT

SEQ ID NO: 6746 - protein, 10 aa, Homo sapiens
SLSVEGRRGP

SEQ ID NO: 6747 - protein, 10 aa, Homo sapiens
SLSWGQRKKL

SEQ ID NO: 6748 - protein, 9 aa, Homo sapiens
SLTEQVHSL

SEQ ID NO: 6749 - protein, 9 aa, Homo sapiens
SLTEYIHHL

SEQ ID NO: 6750 - protein, 9 aa, Homo sapiens
SLTGVQQQL

SEQ ID NO: 6751 - protein, 9 aa, Homo sapiens
SLTRHQFYL

SEQ ID NO: 6752 - protein, 10 aa, Homo sapiens
SLTVDGIMFV

SEQ ID NO: 6753 - protein, 10 aa, Homo sapiens
SLVAVELEKV

SEQ ID NO: 6754 - protein, 10 aa, Homo sapiens
SLVDALLEQV

SEQ ID NO: 6755 - protein, 9 aa, Homo sapiens
SLVDQSAAL

SEQ ID NO: 6756 - protein, 10 aa, Homo sapiens
SLVEFHLKEL

SEQ ID NO: 6757 - protein, 9 aa, Homo sapiens
SLVEIILHV

SEQ ID NO: 6758 - protein, 9 aa, Homo sapiens
SLVENIERL

SEQ ID NO: 6759 - protein, 8 aa, Homo sapiens
SLVGILHL

SEQ ID NO: 6760 - protein, 8 aa, Homo sapiens
SLVINIAA

SEQ ID NO: 6761 - protein, 9 aa, Homo sapiens
SLVKSTSQL

SEQ ID NO: 6762 - protein, 9 aa, Homo sapiens
SLVNVVPKL

SEQ ID NO: 6763 - protein, 9 aa, Homo sapiens
SLVPNRGIL

SEQ ID NO: 6764 - protein, 9 aa, Homo sapiens
SLVQANPEV

SEQ ID NO: 6765 - protein, 9 aa, Homo sapiens
SLVQELKAV

SEQ ID NO: 6766 - protein, 10 aa, Homo sapiens
SLVQGELVTA

SEQ ID NO: 6767 - protein, 9 aa, Homo sapiens
SLVQIVTTL

SEQ ID NO: 6768 - protein, 9 aa, Homo sapiens
SLVQRVETI

SEQ ID NO: 6769 - protein, 9 aa, Homo sapiens
SLVTKVTAV

SEQ ID NO: 6770 - protein, 11 aa, Homo sapiens
SLWEISKQIEG

SEQ ID NO: 6771 - protein, 9 aa, Homo sapiens
SLWEKALKL

SEQ ID NO: 6772 - protein, 10 aa, Homo sapiens
SLWERVSTHV

SEQ ID NO: 6773 - protein, 9 aa, Homo sapiens
SLWETVARA

SEQ ID NO: 6774 - protein, 9 aa, Homo sapiens
SLWKEVSEL

SEQ ID NO: 6775 - protein, 11 aa, Homo sapiens
SLWSLTHLTAL

SEQ ID NO: 6776 - protein, 9 aa, Homo sapiens
SLWSLYPRA

SEQ ID NO: 6777 - protein, 9 aa, Homo sapiens
SLYASPSMV

SEQ ID NO: 6778 - protein, 10 aa, Homo sapiens
SLYDVSRMYV

SEQ ID NO: 6779 - protein, 9 aa, Homo sapiens
SLYEENNKL

SEQ ID NO: 6780 - protein, 11 aa, Homo sapiens
SLYGYGSTVRL

SEQ ID NO: 6781 - protein, 9 aa, Homo sapiens
SLYNALQSL

SEQ ID NO: 6782 - protein, 9 aa, Homo sapiens
SLYNSLETA

SEQ ID NO: 6783 - protein, 10 aa, Homo sapiens
SLYPSAPFLA

SEQ ID NO: 6784 - protein, 9 aa, Homo sapiens
SLYPSIMMA

SEQ ID NO: 6785 - protein, 9 aa, Homo sapiens
SLYSALQQA

SEQ ID NO: 6786 - protein, 10 aa, Homo sapiens
SLYSGLLERL

SEQ ID NO: 6787 - protein, 9 aa, Homo sapiens
SLYTRTLYL

SEQ ID NO: 6788 - protein, 9 aa, Homo sapiens
SMAELDIKL

SEQ ID NO: 6789 - protein, 11 aa, Homo sapiens
SMAEVDAAMAA

SEQ ID NO: 6790 - protein, 9 aa, Homo sapiens
SMAKAITGV

SEQ ID NO: 6791 - protein, 9 aa, Homo sapiens
SMAPYVLNV

SEQ ID NO: 6792 - protein, 9 aa, Homo sapiens
SMAVVIPEA

SEQ ID NO: 6793 - protein, 9 aa, Homo sapiens
SMISKLKQA

SEQ ID NO: 6794 - protein, 9 aa, Homo sapiens
SMLPVPPAV

SEQ ID NO: 6795 - protein, 9 aa, Homo sapiens
SMVDVVMLL

SEQ ID NO: 6796 - protein, 9 aa, Homo sapiens
SMWDDINNV

SEQ ID NO: 6797 - protein, 10 aa, Homo sapiens
SMYGVDLHHA

SEQ ID NO: 6798 - protein, 9 aa, Homo sapiens
STAPPVHNV

SEQ ID NO: 6799 - protein, 11 aa, Homo sapiens
STFDHPELVKL

SEQ ID NO: 6800 - protein, 9 aa, Homo sapiens
SVAGSVERV

SEQ ID NO: 6801 - protein, 9 aa, Homo sapiens
SVIDHIHLI

SEQ ID NO: 6802 - protein, 11 aa, Homo sapiens
SVIDHIHLISV

SEQ ID NO: 6803 - protein, 9 aa, Homo sapiens
SVIGFRILL

SEQ ID NO: 6804 - protein, 9 aa, Homo sapiens
SVLDQKILL

SEQ ID NO: 6805 - protein, 9 aa, Homo sapiens
SVLVSPPAV

SEQ ID NO: 6806 - protein, 9 aa, Homo sapiens
SVMKVKAEL

SEQ ID NO: 6807 - protein, 9 aa, Homo sapiens
SVMSILPKI

SEQ ID NO: 6808 - protein, 10 aa, Homo sapiens
TILPEQLEIL

SEQ ID NO: 6809 - protein, 9 aa, Homo sapiens
TLADYLHLL

SEQ ID NO: 6810 - protein, 10 aa, Homo sapiens
TLAEIAKAEL

SEQ ID NO: 6811 - protein, 11 aa, Homo sapiens
TLAEINQKWNL

SEQ ID NO: 6812 - protein, 9 aa, Homo sapiens
TLAEKIQTI

SEQ ID NO: 6813 - protein, 11 aa, Homo sapiens
TLAEKIQTIIL

SEQ ID NO: 6814 - protein, 10 aa, Homo sapiens
TLAELQNNMV

SEQ ID NO: 6815 - protein, 9 aa, Homo sapiens
TLAGDVHIV

SEQ ID NO: 6816 - protein, 9 aa, Homo sapiens
TLAGLVVQL

SEQ ID NO: 6817 - protein, 9 aa, Homo sapiens
TLANIFAGV

SEQ ID NO: 6818 - protein, 11 aa, Homo sapiens
TLAPGEVLRSV

SEQ ID NO: 6819 - protein, 9 aa, Homo sapiens
TLAPQPSSV

SEQ ID NO: 6820 - protein, 9 aa, Homo sapiens
TLAQQPTAV

SEQ ID NO: 6821 - protein, 10 aa, Homo sapiens
TLASNAIILI

SEQ ID NO: 6822 - protein, 10 aa, Homo sapiens
TLATDILMGV

SEQ ID NO: 6823 - protein, 9 aa, Homo sapiens
TLDDLLLYI

SEQ ID NO: 6824 - protein, 9 aa, Homo sapiens
TLDENHPSI

SEQ ID NO: 6825 - protein, 9 aa, Homo sapiens
TLDPNVTGV

SEQ ID NO: 6826 - protein, 9 aa, Homo sapiens
TLDPVEKAL

SEQ ID NO: 6827 - protein, 9 aa, Homo sapiens
TLDQKIERV

SEQ ID NO: 6828 - protein, 9 aa, Homo sapiens
TLFDYDVGL

SEQ ID NO: 6829 - protein, 9 aa, Homo sapiens
TLFGDVAMV

SEQ ID NO: 6830 - protein, 9 aa, Homo sapiens
TLFLWKIEV

SEQ ID NO: 6831 - protein, 9 aa, Homo sapiens
TLFQGIKTV

SEQ ID NO: 6832 - protein, 9 aa, Homo sapiens
TLFYSLREV

SEQ ID NO: 6833 - protein, 9 aa, Homo sapiens
TLGVIPESV

SEQ ID NO: 6834 - protein, 9 aa, Homo sapiens
TLHSIIISL

SEQ ID NO: 6835 - protein, 10 aa, Homo sapiens
TLIAGPVVEI

SEQ ID NO: 6836 - protein, 9 aa, Homo sapiens
TLIEELKAL

SEQ ID NO: 6837 - protein, 9 aa, Homo sapiens
TLIEESAKV

SEQ ID NO: 6838 - protein, 10 aa, Homo sapiens
TLIEFLLHRA

SEQ ID NO: 6839 - protein, 9 aa, Homo sapiens
TLIEKVQEA

SEQ ID NO: 6840 - protein, 11 aa, Homo sapiens
TLIGEDVNPLI

SEQ ID NO: 6841 - protein, 10 aa, Homo sapiens
TLIGGLLLHV

SEQ ID NO: 6842 - protein, 10 aa, Homo sapiens
TLIKGKIEEV

SEQ ID NO: 6843 - protein, 8 aa, Homo sapiens
TLILANIL

SEQ ID NO: 6844 - protein, 9 aa, Homo sapiens
TLINLLLKV

SEQ ID NO: 6845 - protein, 9 aa, Homo sapiens
TLIQFTVKL

SEQ ID NO: 6846 - protein, 9 aa, Homo sapiens
TLIQRTYGL

SEQ ID NO: 6847 - protein, 11 aa, Homo sapiens
TLIQYIRPVFV

SEQ ID NO: 6848 - protein, 11 aa, Homo sapiens
TLIRSDAVALV

SEQ ID NO: 6849 - protein, 9 aa, Homo sapiens
TLISTAHTL

SEQ ID NO: 6850 - protein, 11 aa, Homo sapiens
TLLADQGEIRV

SEQ ID NO: 6851 - protein, 9 aa, Homo sapiens
TLLAFLVEL

SEQ ID NO: 6852 - protein, 9 aa, Homo sapiens
TLLDFINAV

SEQ ID NO: 6853 - protein, 10 aa, Homo sapiens
TLLDGKLVLL

SEQ ID NO: 6854 - protein, 11 aa, Homo sapiens
TLLDNTDTISI

SEQ ID NO: 6855 - protein, 11 aa, Homo sapiens
TLLEADILNTV

SEQ ID NO: 6856 - protein, 9 aa, Homo sapiens
TLLEEIKAL

SEQ ID NO: 6857 - protein, 9 aa, Homo sapiens
TLLEEIRDL

SEQ ID NO: 6858 - protein, 11 aa, Homo sapiens
TLLEEIRDLAL

SEQ ID NO: 6859 - protein, 9 aa, Homo sapiens
TLLETEMLL

SEQ ID NO: 6860 - protein, 9 aa, Homo sapiens
TLLGDVVRL

SEQ ID NO: 6861 - protein, 9 aa, Homo sapiens
TLLGKVVAL

SEQ ID NO: 6862 - protein, 9 aa, Homo sapiens
TLLGNIHAV

SEQ ID NO: 6863 - protein, 9 aa, Homo sapiens
TLLHFLAEL

SEQ ID NO: 6864 - protein, 9 aa, Homo sapiens
TLLHRFWNL

SEQ ID NO: 6865 - protein, 10 aa, Homo sapiens
TLLIGSPLSL

SEQ ID NO: 6866 - protein, 9 aa, Homo sapiens
TLLKQLPCI

SEQ ID NO: 6867 - protein, 9 aa, Homo sapiens
TLLKSIPLV

SEQ ID NO: 6868 - protein, 9 aa, Homo sapiens
TLLLHTWLL

SEQ ID NO: 6869 - protein, 9 aa, Homo sapiens
TLLNKLYVI

SEQ ID NO: 6870 - protein, 9 aa, Homo sapiens
TLLTAIVKL

SEQ ID NO: 6871 - protein, 9 aa, Homo sapiens
TLLTDPPTA

SEQ ID NO: 6872 - protein, 9 aa, Homo sapiens
TLLTFFHEL

SEQ ID NO: 6873 - protein, 9 aa, Homo sapiens
TLLTKPVEI

SEQ ID NO: 6874 - protein, 9 aa, Homo sapiens
TLLYLDLNL

SEQ ID NO: 6875 - protein, 9 aa, Homo sapiens
TLMAFHVFL

SEQ ID NO: 6876 - protein, 10 aa, Homo sapiens
TLMDMRLSQV

SEQ ID NO: 6877 - protein, 11 aa, Artificial Sequence
  unidentified
VLELDSPGSLV

SEQ ID NO: 6878 - protein, 11 aa, Artificial Sequence
  unidentified
YLIKGKAPEEI

SEQ ID NO: 6879 - protein, 9 aa, Homo sapiens
TLIQFTVKL

SEQ ID NO: 6880 - protein, 9 aa, Homo sapiens
TLIQRTYGL

SEQ ID NO: 6881 - protein, 11 aa, Homo sapiens
TLIQYIRPVFV

SEQ ID NO: 6882 - protein, 11 aa, Homo sapiens
TLIRSDAVALV

SEQ ID NO: 6883 - protein, 9 aa, Homo sapiens
TLISTAHTL

SEQ ID NO: 6884 - protein, 11 aa, Homo sapiens
TLLADQGEIRV

SEQ ID NO: 6885 - protein, 9 aa, Homo sapiens
TLLAFLVEL

SEQ ID NO: 6886 - protein, 9 aa, Homo sapiens
TLLDFINAV

SEQ ID NO: 6887 - protein, 10 aa, Homo sapiens
TLLDGKLVLL

SEQ ID NO: 6888 - protein, 11 aa, Homo sapiens
TLLDNTDTISI

SEQ ID NO: 6889 - protein, 11 aa, Homo sapiens
TLLEADILNTV

SEQ ID NO: 6890 - protein, 9 aa, Homo sapiens
TLLEEIKAL

SEQ ID NO: 6891 - protein, 9 aa, Homo sapiens
TLLEEIRDL

SEQ ID NO: 6892 - protein, 11 aa, Homo sapiens
TLLEEIRDLAL

SEQ ID NO: 6893 - protein, 9 aa, Homo sapiens
TLLETEMLL

SEQ ID NO: 6894 - protein, 9 aa, Homo sapiens
TLLGDVVRL

SEQ ID NO: 6895 - protein, 9 aa, Homo sapiens
TLLGKVVAL

SEQ ID NO: 6896 - protein, 9 aa, Homo sapiens
TLLGNIHAV

SEQ ID NO: 6897 - protein, 9 aa, Homo sapiens
TLLHFLAEL

SEQ ID NO: 6898 - protein, 9 aa, Homo sapiens
TLLHRFWNL

SEQ ID NO: 6899 - protein, 10 aa, Homo sapiens
TLLIGSPLSL

SEQ ID NO: 6900 - protein, 9 aa, Homo sapiens
TLLKQLPCI

SEQ ID NO: 6901 - protein, 9 aa, Homo sapiens
TLLKSIPLV

SEQ ID NO: 6902 - protein, 9 aa, Homo sapiens
TLLLHTWLL

SEQ ID NO: 6903 - protein, 9 aa, Homo sapiens
TLLNKLYVI

SEQ ID NO: 6904 - protein, 9 aa, Homo sapiens
TLLTAIVKL

SEQ ID NO: 6905 - protein, 9 aa, Homo sapiens
TLLTDPPTA

SEQ ID NO: 6906 - protein, 9 aa, Homo sapiens
TLLTFFHEL

SEQ ID NO: 6907 - protein, 9 aa, Homo sapiens
TLLTKPVEI

SEQ ID NO: 6908 - protein, 9 aa, Homo sapiens
TLLYLDLNL

SEQ ID NO: 6909 - protein, 9 aa, Homo sapiens
TLMAFHVFL

SEQ ID NO: 6910 - protein, 10 aa, Homo sapiens
TLMDMRLSQV

SEQ ID NO: 6911 - protein, 10 aa, Homo sapiens
TLMEQAVAAV

SEQ ID NO: 6912 - protein, 10 aa, Homo sapiens
TLMEQPLTTL

SEQ ID NO: 6913 - protein, 11 aa, Homo sapiens
TLMESNKLETI

SEQ ID NO: 6914 - protein, 9 aa, Homo sapiens
TLMEVMPKI

SEQ ID NO: 6915 - protein, 10 aa, Homo sapiens
TLMNLGGLAV

SEQ ID NO: 6916 - protein, 9 aa, Homo sapiens
TLMNLHVYI

SEQ ID NO: 6917 - protein, 8 aa, Homo sapiens
TLNNIKQF

SEQ ID NO: 6918 - protein, 9 aa, Homo sapiens
TLNSAAVTV

SEQ ID NO: 6919 - protein, 10 aa, Homo sapiens
TLPGPPKITL

SEQ ID NO: 6920 - protein, 9 aa, Homo sapiens
TLQAAMPQV

SEQ ID NO: 6921 - protein, 9 aa, Homo sapiens
TLQALVSSV

SEQ ID NO: 6922 - protein, 9 aa, Homo sapiens
TLQDIVYKL

SEQ ID NO: 6923 - protein, 9 aa, Homo sapiens
TLQEFLERI

SEQ ID NO: 6924 - protein, 9 aa, Homo sapiens
TLQEVVTGV

SEQ ID NO: 6925 - protein, 9 aa, Homo sapiens
TLQHIVTLL

SEQ ID NO: 6926 - protein, 10 aa, Homo sapiens
TLQTVPLTTV

SEQ ID NO: 6927 - protein, 10 aa, Homo sapiens
TLRLWDVLIL

SEQ ID NO: 6928 - protein, 9 aa, Homo sapiens
TLSDVLDRV

SEQ ID NO: 6929 - protein, 9 aa, Homo sapiens
TLSQAIVKV

SEQ ID NO: 6930 - protein, 9 aa, Homo sapiens
TLTELRAFL

SEQ ID NO: 6931 - protein, 10 aa, Homo sapiens
TLTGNLFIII

SEQ ID NO: 6932 - protein, 9 aa, Homo sapiens
TLTKVLALV

SEQ ID NO: 6933 - protein, 9 aa, Homo sapiens
TLTSKLYSL

SEQ ID NO: 6934 - protein, 11 aa, Homo sapiens
TLVDNISTMAL

SEQ ID NO: 6935 - protein, 9 aa, Homo sapiens
TLVDNTINL

SEQ ID NO: 6936 - protein, 9 aa, Homo sapiens
TLVEAIKQV

SEQ ID NO: 6937 - protein, 9 aa, Homo sapiens
TLVESLLTI

SEQ ID NO: 6938 - protein, 9 aa, Homo sapiens
TLVVFAINL

SEQ ID NO: 6939 - protein, 10 aa, Homo sapiens
TLWEIAKAEV

SEQ ID NO: 6940 - protein, 9 aa, Homo sapiens
TLWGGLLRL

SEQ ID NO: 6941 - protein, 9 aa, Homo sapiens
TLWNEIERL

SEQ ID NO: 6942 - protein, 9 aa, Homo sapiens
TLWNQELYI

SEQ ID NO: 6943 - protein, 8 aa, Homo sapiens
TLWVDPYE

SEQ ID NO: 6944 - protein, 9 aa, Homo sapiens
TLWYRSPEV

SEQ ID NO: 6945 - protein, 9 aa, Homo sapiens
TLYDIRAEL

SEQ ID NO: 6946 - protein, 9 aa, Homo sapiens
TLYDSRLFV

SEQ ID NO: 6947 - protein, 10 aa, Homo sapiens
TLYEGEKFQL

SEQ ID NO: 6948 - protein, 9 aa, Homo sapiens
TLYEQSVWI

SEQ ID NO: 6949 - protein, 10 aa, Homo sapiens
TLYERGFENI

SEQ ID NO: 6950 - protein, 9 aa, Homo sapiens
TLYGSQIKL

SEQ ID NO: 6951 - protein, 9 aa, Homo sapiens
TLYHLRLLV

SEQ ID NO: 6952 - protein, 9 aa, Homo sapiens
TLYILALEN

SEQ ID NO: 6953 - protein, 11 aa, Homo sapiens
TLYKDVRDLLA

SEQ ID NO: 6954 - protein, 11 aa, Homo sapiens
TLYNPERTITV

SEQ ID NO: 6955 - protein, 10 aa, Homo sapiens
TLYPLHILFV

SEQ ID NO: 6956 - protein, 9 aa, Homo sapiens
TMADQIVTV

SEQ ID NO: 6957 - protein, 9 aa, Homo sapiens
TMFEFAFHL

SEQ ID NO: 6958 - protein, 11 aa, Homo sapiens
TMIDDEALKEV

SEQ ID NO: 6959 - protein, 9 aa, Homo sapiens
TMLGVSHVV

SEQ ID NO: 6960 - protein, 10 aa, Homo sapiens
TMLHLTDIQL

SEQ ID NO: 6961 - protein, 9 aa, Homo sapiens
TQILSVPKV

SEQ ID NO: 6962 - protein, 9 aa, Homo sapiens
TTFDKEFLL

SEQ ID NO: 6963 - protein, 9 aa, Homo sapiens
TTLEQPPSV

SEQ ID NO: 6964 - protein, 8 aa, Homo sapiens
TVVNIVGV

SEQ ID NO: 6965 - protein, 9 aa, Homo sapiens
VIDKLVVHL

SEQ ID NO: 6966 - protein, 9 aa, Homo sapiens
VIFQKVVNV

SEQ ID NO: 6967 - protein, 9 aa, Homo sapiens
VIHNLATYV

SEQ ID NO: 6968 - protein, 9 aa, Homo sapiens
VIINQIYEA

SEQ ID NO: 6969 - protein, 9 aa, Homo sapiens
VIMERLQQV

SEQ ID NO: 6970 - protein, 9 aa, Homo sapiens
VINNVLATI

SEQ ID NO: 6971 - protein, 9 aa, Homo sapiens
VITETVVEV

SEQ ID NO: 6972 - protein, 9 aa, Homo sapiens
VLADSVHLA

SEQ ID NO: 6973 - protein, 9 aa, Homo sapiens
VLADVKVHI

SEQ ID NO: 6974 - protein, 10 aa, Homo sapiens
VLADVMDDQL

SEQ ID NO: 6975 - protein, 11 aa, Homo sapiens
VLAEDEEMNRM

SEQ ID NO: 6976 - protein, 9 aa, Homo sapiens
VLAELKEYA

SEQ ID NO: 6977 - protein, 9 aa, Homo sapiens
VLAELVAKL

SEQ ID NO: 6978 - protein, 9 aa, Homo sapiens
VLAFENPQV

SEQ ID NO: 6979 - protein, 9 aa, Homo sapiens
VLAFLVHEL

SEQ ID NO: 6980 - protein, 9 aa, Homo sapiens
VLAKEIGLL

SEQ ID NO: 6981 - protein, 11 aa, Homo sapiens
VLAPGHAVPPA

SEQ ID NO: 6982 - protein, 11 aa, Homo sapiens
VLAPVPTHSTV

SEQ ID NO: 6983 - protein, 11 aa, Homo sapiens
VLAQPEAISTI

SEQ ID NO: 6984 - protein, 9 aa, Homo sapiens
VLAQQIATL

SEQ ID NO: 6985 - protein, 9 aa, Homo sapiens
VLAQVFTEL

SEQ ID NO: 6986 - protein, 9 aa, Homo sapiens
VLASLIIRL

SEQ ID NO: 6987 - protein, 9 aa, Homo sapiens
VLATFVHML

SEQ ID NO: 6988 - protein, 10 aa, Homo sapiens
VLAVGIDGAN

SEQ ID NO: 6989 - protein, 10 aa, Homo sapiens
VLDDNKLLTL

SEQ ID NO: 6990 - protein, 10 aa, Homo sapiens
VLDELKNMKC

SEQ ID NO: 6991 - protein, 9 aa, Homo sapiens
VLDITRLLL

SEQ ID NO: 6992 - protein, 9 aa, Homo sapiens
VLDKLLLYL

SEQ ID NO: 6993 - protein, 9 aa, Homo sapiens
VLDMAKVLL

SEQ ID NO: 6994 - protein, 8 aa, Homo sapiens
VLDPRDII

SEQ ID NO: 6995 - protein, 11 aa, Homo sapiens
VLDTLSQLLKV

SEQ ID NO: 6996 - protein, 10 aa, Homo sapiens
VLDTLTKVLV

SEQ ID NO: 6997 - protein, 9 aa, Homo sapiens
VLDTPPDPA

SEQ ID NO: 6998 - protein, 9 aa, Homo sapiens
VLEDPVHAV

SEQ ID NO: 6999 - protein, 9 aa, Homo sapiens
VLEHFALLL

SEQ ID NO: 7000 - protein, 9 aa, Homo sapiens
VLESSNPKM

SEQ ID NO: 7001 - protein, 11 aa, Homo sapiens
VLFDVTGQVRL

SEQ ID NO: 7002 - protein, 10 aa, Homo sapiens
VLFESEFVHV

SEQ ID NO: 7003 - protein, 10 aa, Homo sapiens
VLFGAVITGA

SEQ ID NO: 7004 - protein, 9 aa, Homo sapiens
VLFPLLTKL

SEQ ID NO: 7005 - protein, 9 aa, Homo sapiens
VLFPLPTPL

SEQ ID NO: 7006 - protein, 11 aa, Homo sapiens
VLFPSAEVALL

SEQ ID NO: 7007 - protein, 10 aa, Homo sapiens
VLFQEALWHV

SEQ ID NO: 7008 - protein, 9 aa, Homo sapiens
VLFSSPPQM

SEQ ID NO: 7009 - protein, 9 aa, Homo sapiens
VLGEFLKEI

SEQ ID NO: 7010 - protein, 9 aa, Homo sapiens
VLGELVPRL

SEQ ID NO: 7011 - protein, 8 aa, Homo sapiens
VLGIVVGV

SEQ ID NO: 7012 - protein, 9 aa, Homo sapiens
VLGPGPPPL

SEQ ID NO: 7013 - protein, 9 aa, Homo sapiens
VLHDRIVSV

SEQ ID NO: 7014 - protein, 9 aa, Homo sapiens
VLHGQEISV

SEQ ID NO: 7015 - protein, 9 aa, Homo sapiens
VLHHTLTNV

SEQ ID NO: 7016 - protein, 10 aa, Homo sapiens
VLHPGLLAQV

SEQ ID NO: 7017 - protein, 9 aa, Homo sapiens
VLHRNLIYL

SEQ ID NO: 7018 - protein, 9 aa, Homo sapiens
VLIDDLTTL

SEQ ID NO: 7019 - protein, 11 aa, Homo sapiens
VLIDELHGLLL

SEQ ID NO: 7020 - protein, 9 aa, Homo sapiens
VLIDEVESL

SEQ ID NO: 7021 - protein, 10 aa, Homo sapiens
VLIDKLLPKL

SEQ ID NO: 7022 - protein, 11 aa, Homo sapiens
VLIDTPGQIEV

SEQ ID NO: 7023 - protein, 11 aa, Homo sapiens
VLIDVGTGYYV

SEQ ID NO: 7024 - protein, 9 aa, Homo sapiens
VLIETLVTL

SEQ ID NO: 7025 - protein, 9 aa, Homo sapiens
VLIEVNPQT

SEQ ID NO: 7026 - protein, 11 aa, Homo sapiens
VLIGEGVLTKL

SEQ ID NO: 7027 - protein, 9 aa, Homo sapiens
VLIGENEKA

SEQ ID NO: 7028 - protein, 10 aa, Homo sapiens
VLIGTFIAHV

SEQ ID NO: 7029 - protein, 11 aa, Homo sapiens
VLIGVGKLLRV

SEQ ID NO: 7030 - protein, 9 aa, Homo sapiens
VLIHELAEA

SEQ ID NO: 7031 - protein, 9 aa, Homo sapiens
VLIKDLFHI

SEQ ID NO: 7032 - protein, 10 aa, Homo sapiens
VLIKEGGVQL

SEQ ID NO: 7033 - protein, 10 aa, Homo sapiens
VLIKNLLISV

SEQ ID NO: 7034 - protein, 9 aa, Homo sapiens
VLIKWFPEV

SEQ ID NO: 7035 - protein, 9 aa, Homo sapiens
VLINRIDLV

SEQ ID NO: 7036 - protein, 9 aa, Homo sapiens
VLINTSVTL

SEQ ID NO: 7037 - protein, 8 aa, Homo sapiens
VLIPDQKY

SEQ ID NO: 7038 - protein, 10 aa, Homo sapiens
VLIRDLNFEV

SEQ ID NO: 7039 - protein, 9 aa, Homo sapiens
VLIRELWNT

SEQ ID NO: 7040 - protein, 10 aa, Homo sapiens
VLISGVVHEI

SEQ ID NO: 7041 - protein, 9 aa, Homo sapiens
VLISTLQEL

SEQ ID NO: 7042 - protein, 9 aa, Homo sapiens
VLISVLQAI

SEQ ID NO: 7043 - protein, 9 aa, Homo sapiens
VLITTLITA

SEQ ID NO: 7044 - protein, 9 aa, Homo sapiens
VLKAALADV

SEQ ID NO: 7045 - protein, 9 aa, Homo sapiens
VLKAEALAL

SEQ ID NO: 7046 - protein, 11 aa, Homo sapiens
VLLDADGHIKL

SEQ ID NO: 7047 - protein, 11 aa, Homo sapiens
VLLDENLLKMV

SEQ ID NO: 7048 - protein, 9 aa, Homo sapiens
VLLDITPMM

SEQ ID NO: 7049 - protein, 11 aa, Homo sapiens
VLLDSEGHIVL

SEQ ID NO: 7050 - protein, 11 aa, Homo sapiens
VLLEALALRNV

SEQ ID NO: 7051 - protein, 10 aa, Homo sapiens
VLLEAQDMAV

SEQ ID NO: 7052 - protein, 11 aa, Homo sapiens
VLLEDGVLNHV

SEQ ID NO: 7053 - protein, 11 aa, Homo sapiens
VLLEEGEAQRL

SEQ ID NO: 7054 - protein, 9 aa, Homo sapiens
VLLELLPRL

SEQ ID NO: 7055 - protein, 10 aa, Homo sapiens
VLLEPFIHQV

SEQ ID NO: 7056 - protein, 10 aa, Homo sapiens
VLLEPFVHQV

SEQ ID NO: 7057 - protein, 9 aa, Homo sapiens
VLLESKILL

SEQ ID NO: 7058 - protein, 11 aa, Homo sapiens
VLLFEADTITL

SEQ ID NO: 7059 - protein, 10 aa, Homo sapiens
VLLGHLLMEL

SEQ ID NO: 7060 - protein, 9 aa, Homo sapiens
VLLHLLHNV

SEQ ID NO: 7061 - protein, 9 aa, Homo sapiens
VLLKIVEQI

SEQ ID NO: 7062 - protein, 9 aa, Homo sapiens
VLLLNPVEV

SEQ ID NO: 7063 - protein, 9 aa, Homo sapiens
VLLLQPKIP

SEQ ID NO: 7064 - protein, 10 aa, Homo sapiens
VLLNEILEQV

SEQ ID NO: 7065 - protein, 9 aa, Homo sapiens
VLLNNKLYV

SEQ ID NO: 7066 - protein, 8 aa, Homo sapiens
VLLNPEKY

SEQ ID NO: 7067 - protein, 11 aa, Homo sapiens
VLLPDERTISL

SEQ ID NO: 7068 - protein, 9 aa, Homo sapiens
VLLPEHSLV

SEQ ID NO: 7069 - protein, 9 aa, Homo sapiens
VLLPELPTL

SEQ ID NO: 7070 - protein, 9 aa, Homo sapiens
VLLPLRVTL

SEQ ID NO: 7071 - protein, 9 aa, Homo sapiens
VLLSEILHL

SEQ ID NO: 7072 - protein, 11 aa, Homo sapiens
VLLSEQGDVKL

SEQ ID NO: 7073 - protein, 11 aa, Homo sapiens
VLLSHPDPLHL

SEQ ID NO: 7074 - protein, 9 aa, Homo sapiens
VLLSPVPEL

SEQ ID NO: 7075 - protein, 9 aa, Homo sapiens
VLLTMIARV

SEQ ID NO: 7076 - protein, 9 aa, Homo sapiens
VLLTVLERV

SEQ ID NO: 7077 - protein, 9 aa, Homo sapiens
VLLTWKYLL

SEQ ID NO: 7078 - protein, 11 aa, Homo sapiens
VLLVEHALSKV

SEQ ID NO: 7079 - protein, 11 aa, Homo sapiens
VLMDEGAVLTL

SEQ ID NO: 7080 - protein, 9 aa, Homo sapiens
VLMDGSVKL

SEQ ID NO: 7081 - protein, 10 aa, Homo sapiens
VLMDGSVKLV

SEQ ID NO: 7082 - protein, 9 aa, Homo sapiens
VLMDLKALL

SEQ ID NO: 7083 - protein, 10 aa, Homo sapiens
VLMDLKALLL

SEQ ID NO: 7084 - protein, 10 aa, Homo sapiens
VLMEGVKTEV

SEQ ID NO: 7085 - protein, 9 aa, Homo sapiens
VLMKALEYL

SEQ ID NO: 7086 - protein, 9 aa, Homo sapiens
VLMNQPPQI

SEQ ID NO: 7087 - protein, 9 aa, Homo sapiens
VLMNSLERL

SEQ ID NO: 7088 - protein, 11 aa, Homo sapiens
VLMPMERQMSV

SEQ ID NO: 7089 - protein, 9 aa, Homo sapiens
VLMQDLAFL

SEQ ID NO: 7090 - protein, 9 aa, Homo sapiens
VLMWEIYSL

SEQ ID NO: 7091 - protein, 9 aa, Homo sapiens
VLNKEAVEV

SEQ ID NO: 7092 - protein, 9 aa, Homo sapiens
VLPPDTDPA

SEQ ID NO: 7093 - protein, 9 aa, Homo sapiens
VLPSSLISI

SEQ ID NO: 7094 - protein, 10 aa, Homo sapiens
VLQDKDLFSV

SEQ ID NO: 7095 - protein, 9 aa, Homo sapiens
VLQDTVEQL

SEQ ID NO: 7096 - protein, 10 aa, Homo sapiens
VLQDYIILPT

SEQ ID NO: 7097 - protein, 9 aa, Homo sapiens
VLQGLEIEL

SEQ ID NO: 7098 - protein, 9 aa, Homo sapiens
VLQHGAAAA

SEQ ID NO: 7099 - protein, 9 aa, Homo sapiens
VLQQKLEAI

SEQ ID NO: 7100 - protein, 9 aa, Homo sapiens
VLQTVLQEV

SEQ ID NO: 7101 - protein, 8 aa, Homo sapiens
VLQTVLSL

SEQ ID NO: 7102 - protein, 9 aa, Homo sapiens
VLSEENFKV

SEQ ID NO: 7103 - protein, 9 aa, Homo sapiens
VLSELLWQV

SEQ ID NO: 7104 - protein, 9 aa, Homo sapiens
VLSSLNIKL

SEQ ID NO: 7105 - protein, 10 aa, Homo sapiens
VLSWEHLLEL

SEQ ID NO: 7106 - protein, 10 aa, Homo sapiens
VLTELINLHL

SEQ ID NO: 7107 - protein, 9 aa, Homo sapiens
VLTESPPSL

SEQ ID NO: 7108 - protein, 9 aa, Homo sapiens
VLTNKLLTV

SEQ ID NO: 7109 - protein, 9 aa, Homo sapiens
VLTSLVALR

SEQ ID NO: 7110 - protein, 9 aa, Homo sapiens
VLTVDGEQV

SEQ ID NO: 7111 - protein, 9 aa, Homo sapiens
VLVEDLTQV

SEQ ID NO: 7112 - protein, 9 aa, Homo sapiens
VLVEHVKNV

SEQ ID NO: 7113 - protein, 9 aa, Homo sapiens
VLVQLIHSV

SEQ ID NO: 7114 - protein, 9 aa, Homo sapiens
VLVQVSPSL

SEQ ID NO: 7115 - protein, 9 aa, Homo sapiens
VLVSQTNEL

SEQ ID NO: 7116 - protein, 10 aa, Homo sapiens
VLVTAGEVHL

SEQ ID NO: 7117 - protein, 10 aa, Homo sapiens
VLVTLAGIIV

SEQ ID NO: 7118 - protein, 9 aa, Homo sapiens
VLWAMVMRI

SEQ ID NO: 7119 - protein, 9 aa, Homo sapiens
VLWDLVDRI

SEQ ID NO: 7120 - protein, 9 aa, Homo sapiens
VLWDQYHNL

SEQ ID NO: 7121 - protein, 11 aa, Homo sapiens
VLWELAHLPTL

SEQ ID NO: 7122 - protein, 9 aa, Homo sapiens
VLWKDIQHA

SEQ ID NO: 7123 - protein, 11 aa, Homo sapiens
VLWMAPDGLYA

SEQ ID NO: 7124 - protein, 9 aa, Homo sapiens
VLWTMVIHI

SEQ ID NO: 7125 - protein, 10 aa, Homo sapiens
VLYDAKIVDV

SEQ ID NO: 7126 - protein, 9 aa, Homo sapiens
VLYDRLLKL

SEQ ID NO: 7127 - protein, 9 aa, Homo sapiens
VLYDWKERL

SEQ ID NO: 7128 - protein, 10 aa, Homo sapiens
VLYGGLLEHL

SEQ ID NO: 7129 - protein, 9 aa, Homo sapiens
VLYKWTNYL

SEQ ID NO: 7130 - protein, 10 aa, Homo sapiens
VLYNQRVEEI

SEQ ID NO: 7131 - protein, 9 aa, Homo sapiens
VLYPHPPLA

SEQ ID NO: 7132 - protein, 9 aa, Homo sapiens
VLYPSLKEI

SEQ ID NO: 7133 - protein, 9 aa, Homo sapiens
VMAEAPPGV

SEQ ID NO: 7134 - protein, 11 aa, Homo sapiens
VMFEDGVLMRL

SEQ ID NO: 7135 - protein, 9 aa, Homo sapiens
VQDDIKESV

SEQ ID NO: 7136 - protein, 9 aa, Homo sapiens
VQDENVRGV

SEQ ID NO: 7137 - protein, 10 aa, Homo sapiens
VQDPNTGFSV

SEQ ID NO: 7138 - protein, 9 aa, Homo sapiens
VQTAELTKV

SEQ ID NO: 7139 - protein, 10 aa, Homo sapiens
VTIVETPPMV

SEQ ID NO: 7140 - protein, 9 aa, Homo sapiens
VVAEELENV

SEQ ID NO: 7141 - protein, 9 aa, Homo sapiens
VVDAVVTQV

SEQ ID NO: 7142 - protein, 10 aa, Homo sapiens
VVIEKTSPPV

SEQ ID NO: 7143 - protein, 9 aa, Homo sapiens
VVSGPPPAV

SEQ ID NO: 7144 - protein, 9 aa, Homo sapiens
VVWGTVIRV

SEQ ID NO: 7145 - protein, 11 aa, Homo sapiens
WLAGYVFLVLL

SEQ ID NO: 7146 - protein, 9 aa, Homo sapiens
WLAHAIQTV

SEQ ID NO: 7147 - protein, 10 aa, Homo sapiens
WLAQQAAKAM

SEQ ID NO: 7148 - protein, 10 aa, Homo sapiens
WLKNGAALVL

SEQ ID NO: 7149 - protein, 9 aa, Homo sapiens
WLLQTHWTL

SEQ ID NO: 7150 - protein, 9 aa, Homo sapiens
WLQLQIPRI

SEQ ID NO: 7151 - protein, 11 aa, Homo sapiens
WLRYQGVPVEE

SEQ ID NO: 7152 - protein, 9 aa, Homo sapiens
WLYGEDHQI

SEQ ID NO: 7153 - protein, 9 aa, Homo sapiens
WVDETLSSV

SEQ ID NO: 7154 - protein, 8 aa, Homo sapiens
WVLSQVQL

SEQ ID NO: 7155 - protein, 9 aa, Homo sapiens
YCAEIAHNV

SEQ ID NO: 7156 - protein, 9 aa, Homo sapiens
YCYDNIHFM

SEQ ID NO: 7157 - protein, 9 aa, Homo sapiens
YGLPVVVKL

SEQ ID NO: 7158 - protein, 10 aa, Homo sapiens
YILEGEPGKV

SEQ ID NO: 7159 - protein, 9 aa, Homo sapiens
YILGKFFAL

SEQ ID NO: 7160 - protein, 9 aa, Homo sapiens
YILKIVPTV

SEQ ID NO: 7161 - protein, 9 aa, Homo sapiens
YISFQPPGV

SEQ ID NO: 7162 - protein, 10 aa, Homo sapiens
YITLTGVHQV

SEQ ID NO: 7163 - protein, 9 aa, Homo sapiens
YIYHGTVKL

SEQ ID NO: 7164 - protein, 10 aa, Homo sapiens
YLADLLMPHL

SEQ ID NO: 7165 - protein, 9 aa, Homo sapiens
YLADQNNQV

SEQ ID NO: 7166 - protein, 9 aa, Homo sapiens
YLAHLAHHL

SEQ ID NO: 7167 - protein, 9 aa, Homo sapiens
YLAKVKSLL

SEQ ID NO: 7168 - protein, 10 aa, Homo sapiens
YLARIQGFQV

SEQ ID NO: 7169 - protein, 10 aa, Homo sapiens
YLASDEITTV

SEQ ID NO: 7170 - protein, 9 aa, Homo sapiens
YLAVESPFL

SEQ ID NO: 7171 - protein, 9 aa, Homo sapiens
YLCYEVERL

SEQ ID NO: 7172 - protein, 10 aa, Homo sapiens
YLDGHLITTV

SEQ ID NO: 7173 - protein, 10 aa, Homo sapiens
YLDHTADVQL

SEQ ID NO: 7174 - protein, 9 aa, Homo sapiens
YLDIARYLL

SEQ ID NO: 7175 - protein, 10 aa, Homo sapiens
YLDIKGLLDV

SEQ ID NO: 7176 - protein, 9 aa, Homo sapiens
YLDKMNNNI

SEQ ID NO: 7177 - protein, 10 aa, Homo sapiens
YLDPRLAFTV

SEQ ID NO: 7178 - protein, 9 aa, Homo sapiens
YLDPVQRDL

SEQ ID NO: 7179 - protein, 10 aa, Homo sapiens
YLDQGTQIFL

SEQ ID NO: 7180 - protein, 9 aa, Homo sapiens
YLDQRELLL

SEQ ID NO: 7181 - protein, 9 aa, Homo sapiens
YLDTINRSV

SEQ ID NO: 7182 - protein, 9 aa, Homo sapiens
YLDVVQSNV

SEQ ID NO: 7183 - protein, 9 aa, Homo sapiens
YLEDTDRNL

SEQ ID NO: 7184 - protein, 9 aa, Homo sapiens
YLFAVNIKL

SEQ ID NO: 7185 - protein, 9 aa, Homo sapiens
YLFDLPLKV

SEQ ID NO: 7186 - protein, 9 aa, Homo sapiens
YLFEEIAKI

SEQ ID NO: 7187 - protein, 9 aa, Homo sapiens
YLFGERLLE

SEQ ID NO: 7188 - protein, 11 aa, Homo sapiens
YLFHIAGAYLL

SEQ ID NO: 7189 - protein, 10 aa, Homo sapiens
YLFHREVQAV

SEQ ID NO: 7190 - protein, 9 aa, Homo sapiens
YLFPRQLLI

SEQ ID NO: 7191 - protein, 10 aa, Homo sapiens
YLFSEALNAA

SEQ ID NO: 7192 - protein, 9 aa, Homo sapiens
YLGDLLETC

SEQ ID NO: 7193 - protein, 11 aa, Homo sapiens
YLGLDGFVERI

SEQ ID NO: 7194 - protein, 10 aa, Homo sapiens
YLGLLENVRV

SEQ ID NO: 7195 - protein, 9 aa, Homo sapiens
YLGPVSPSL

SEQ ID NO: 7196 - protein, 9 aa, Homo sapiens
YLGRLAHEV

SEQ ID NO: 7197 - protein, 9 aa, Homo sapiens
YLHEFLTSA

SEQ ID NO: 7198 - protein, 11 aa, Homo sapiens
YLHNPSSEETI

SEQ ID NO: 7199 - protein, 9 aa, Homo sapiens
YLHREVVEL

SEQ ID NO: 7200 - protein, 9 aa, Homo sapiens
YLHSGQVAL

SEQ ID NO: 7201 - protein, 9 aa, Homo sapiens
YLHTNVALV

SEQ ID NO: 7202 - protein, 9 aa, Homo sapiens
YLHTTIFGL

SEQ ID NO: 7203 - protein, 9 aa, Homo sapiens
YLHWGHFEM

SEQ ID NO: 7204 - protein, 9 aa, Homo sapiens
YLHWLLTNI

SEQ ID NO: 7205 - protein, 9 aa, Homo sapiens
YLIAHLPRL

SEQ ID NO: 7206 - protein, 9 aa, Homo sapiens
YLIARVMLL

SEQ ID NO: 7207 - protein, 9 aa, Homo sapiens
YLIEKSRVV

SEQ ID NO: 7208 - protein, 11 aa, Homo sapiens
YLIGQHVTAAL

SEQ ID NO: 7209 - protein, 9 aa, Homo sapiens
YLIGVHASL

SEQ ID NO: 7210 - protein, 9 aa, Homo sapiens
YLIHLLQEL

SEQ ID NO: 7211 - protein, 9 aa, Homo sapiens
YLIKFLAKL

SEQ ID NO: 7212 - protein, 9 aa, Homo sapiens
YLILHLIST

SEQ ID NO: 7213 - protein, 10 aa, Homo sapiens
YLINSPVVRA

SEQ ID NO: 7214 - protein, 9 aa, Homo sapiens
YLITSVELL

SEQ ID NO: 7215 - protein, 9 aa, Homo sapiens
YLKDEIEEL

SEQ ID NO: 7216 - protein, 9 aa, Homo sapiens
YLKDFFSNV

SEQ ID NO: 7217 - protein, 10 aa, Homo sapiens
YLKDGPYITA

SEQ ID NO: 7218 - protein, 9 aa, Homo sapiens
YLKEILEQL

SEQ ID NO: 7219 - protein, 11 aa, Homo sapiens
YLKIQPGAVPG

SEQ ID NO: 7220 - protein, 9 aa, Homo sapiens
YLLASKAYL

SEQ ID NO: 7221 - protein, 10 aa, Homo sapiens
YLLDDGTLVV

SEQ ID NO: 7222 - protein, 10 aa, Homo sapiens
YLLDHLHLEL

SEQ ID NO: 7223 - protein, 10 aa, Homo sapiens
YLLDLHSYLL

SEQ ID NO: 7224 - protein, 9 aa, Homo sapiens
YLLDLLRLP

SEQ ID NO: 7225 - protein, 10 aa, Homo sapiens
YLLDLPNPVI

SEQ ID NO: 7226 - protein, 11 aa, Homo sapiens
YLLDPKIADLV

SEQ ID NO: 7227 - protein, 9 aa, Homo sapiens
YLLDRLPEM

SEQ ID NO: 7228 - protein, 10 aa, Homo sapiens
YLLEEKIASL

SEQ ID NO: 7229 - protein, 10 aa, Homo sapiens
YLLEENKIKL

SEQ ID NO: 7230 - protein, 9 aa, Homo sapiens
YLLEKSRLV

SEQ ID NO: 7231 - protein, 9 aa, Homo sapiens
YLLEKSRVL

SEQ ID NO: 7232 - protein, 9 aa, Homo sapiens
YLLEKSRVV

SEQ ID NO: 7233 - protein, 10 aa, Homo sapiens
YLLEQDFPGM

SEQ ID NO: 7234 - protein, 9 aa, Homo sapiens
YLLEQGAQV

SEQ ID NO: 7235 - protein, 11 aa, Homo sapiens
YLLEQIKLIEV

SEQ ID NO: 7236 - protein, 10 aa, Homo sapiens
YLLKFEQIYL

SEQ ID NO: 7237 - protein, 11 aa, Homo sapiens
YLLNDASLISV

SEQ ID NO: 7238 - protein, 9 aa, Homo sapiens
YLLPFISKL

SEQ ID NO: 7239 - protein, 9 aa, Homo sapiens
YLLPLLQRL

SEQ ID NO: 7240 - protein, 9 aa, Homo sapiens
YLLPVKMLL

SEQ ID NO: 7241 - protein, 9 aa, Homo sapiens
YLLQSVNQL

SEQ ID NO: 7242 - protein, 9 aa, Homo sapiens
YLLREWVNL

SEQ ID NO: 7243 - protein, 11 aa, Homo sapiens
YLLSEKDLILA

SEQ ID NO: 7244 - protein, 9 aa, Homo sapiens
YLNALVHLI

SEQ ID NO: 7245 - protein, 9 aa, Homo sapiens
YLNDGLWHM

SEQ ID NO: 7246 - protein, 9 aa, Homo sapiens
YLNEIKDSV

SEQ ID NO: 7247 - protein, 11 aa, Homo sapiens
YLNEIKDSVVA

SEQ ID NO: 7248 - protein, 11 aa, Homo sapiens
YLNEQGDRVYT

SEQ ID NO: 7249 - protein, 9 aa, Homo sapiens
YLNEQVKAI

SEQ ID NO: 7250 - protein, 9 aa, Homo sapiens
YLPHAPPFA

SEQ ID NO: 7251 - protein, 9 aa, Homo sapiens
YLQDLLAWV

SEQ ID NO: 7252 - protein, 9 aa, Homo sapiens
YLQDTMNHV

SEQ ID NO: 7253 - protein, 9 aa, Homo sapiens
YLQDVIMQV

SEQ ID NO: 7254 - protein, 9 aa, Homo sapiens
YLQEQAYRL

SEQ ID NO: 7255 - protein, 9 aa, Homo sapiens
YLQLTQSEL

SEQ ID NO: 7256 - protein, 9 aa, Homo sapiens
YLQPFLAKL

SEQ ID NO: 7257 - protein, 9 aa, Homo sapiens
YLSAKVEAL

SEQ ID NO: 7258 - protein, 10 aa, Homo sapiens
YLSEVGDTQV

SEQ ID NO: 7259 - protein, 9 aa, Homo sapiens
YLSLLNQQL

SEQ ID NO: 7260 - protein, 9 aa, Homo sapiens
YLSQLDLII

SEQ ID NO: 7261 - protein, 9 aa, Homo sapiens
YLSVKIWDL

SEQ ID NO: 7262 - protein, 9 aa, Homo sapiens
YLTAATHGL

SEQ ID NO: 7263 - protein, 9 aa, Homo sapiens
YLTDLQVSL

SEQ ID NO: 7264 - protein, 9 aa, Homo sapiens
YLTQVDILL

SEQ ID NO: 7265 - protein, 9 aa, Homo sapiens
YLTSKIFGI

SEQ ID NO: 7266 - protein, 10 aa, Homo sapiens
YLTTLRALYL

SEQ ID NO: 7267 - protein, 9 aa, Homo sapiens
YLVDNKLHL

SEQ ID NO: 7268 - protein, 9 aa, Homo sapiens
YLVEGRFSV

SEQ ID NO: 7269 - protein, 10 aa, Homo sapiens
YLVEINKILL

SEQ ID NO: 7270 - protein, 9 aa, Homo sapiens
YLVGNVCIL

SEQ ID NO: 7271 - protein, 9 aa, Homo sapiens
YLVTGVTTV

SEQ ID NO: 7272 - protein, 9 aa, Homo sapiens
YLVTKVVAV

SEQ ID NO: 7273 - protein, 9 aa, Homo sapiens
YLVTSIAKA

SEQ ID NO: 7274 - protein, 10 aa, Homo sapiens
YLWDLDHGFA

SEQ ID NO: 7275 - protein, 10 aa, Homo sapiens
YLWHIPLSYV

SEQ ID NO: 7276 - protein, 9 aa, Homo sapiens
YLWLKLNQV

SEQ ID NO: 7277 - protein, 9 aa, Homo sapiens
YLWNLQVKL

SEQ ID NO: 7278 - protein, 9 aa, Homo sapiens
YLWNTVSKL

SEQ ID NO: 7279 - protein, 9 aa, Homo sapiens
YLWSRVEKL

SEQ ID NO: 7280 - protein, 10 aa, Homo sapiens
YLYDSETKNA

SEQ ID NO: 7281 - protein, 10 aa, Homo sapiens
YLYNNMIAKI

SEQ ID NO: 7282 - protein, 10 aa, Homo sapiens
YLYNRLMDFL

SEQ ID NO: 7283 - protein, 10 aa, Homo sapiens
YLYPSTLVRT

SEQ ID NO: 7284 - protein, 9 aa, Homo sapiens
YLYQEQYFI

SEQ ID NO: 7285 - protein, 10 aa, Homo sapiens
YLYQHVLATL

SEQ ID NO: 7286 - protein, 10 aa, Homo sapiens
YLYSGHTVML

SEQ ID NO: 7287 - protein, 9 aa, Homo sapiens
YLYSLEVQL

SEQ ID NO: 7288 - protein, 10 aa, Homo sapiens
YLYSNKLQSL

SEQ ID NO: 7289 - protein, 9 aa, Homo sapiens
YMDQWVPVI

SEQ ID NO: 7290 - protein, 9 aa, Homo sapiens
YMGETETKV

SEQ ID NO: 7291 - protein, 9 aa, Homo sapiens
YMGQSIHQV

SEQ ID NO: 7292 - protein, 9 aa, Homo sapiens
YMMPVNSEV

SEQ ID NO: 7293 - protein, 9 aa, Homo sapiens
YMSDSFINV

SEQ ID NO: 7294 - protein, 9 aa, Homo sapiens
YMVHIQVTL

SEQ ID NO: 7295 - protein, 11 aa, Homo sapiens
YQFGEIRTITV

SEQ ID NO: 7296 - protein, 9 aa, Homo sapiens
YQLEEIQRV

SEQ ID NO: 7297 - protein, 9 aa, Homo sapiens
YSDIDIILL

SEQ ID NO: 7298 - protein, 11 aa, Homo sapiens
YTLPIASSIRL

SEQ ID NO: 7299 - protein, 9 aa, Homo sapiens
YTWEEVFRV

SEQ ID NO: 7300 - protein, 9 aa, Homo sapiens
YVSEILEKV

SEQ ID NO: 7301 - protein, 12 aa, Homo sapiens
AEPLEIILHLPL

SEQ ID NO: 7302 - protein, 10 aa, Homo sapiens
ALIAAGKEII

SEQ ID NO: 7303 - protein, 11 aa, Homo sapiens
APKISMPDIDL

SEQ ID NO: 7304 - protein, 11 aa, Homo sapiens
APSTVPIMHQV

SEQ ID NO: 7305 - protein, 12 aa, Homo sapiens
CQIGCCYRAKVF

SEQ ID NO: 7306 - protein, 11 aa, Toxoplasma gondii ME49
FILPDSLPLDT

SEQ ID NO: 7307 - protein, 9 aa, Homo sapiens
FLPQKIIYL

SEQ ID NO: 7308 - protein, 12 aa, Homo sapiens
FRSPLSTGVKDL

SEQ ID NO: 7309 - protein, 11 aa, Homo sapiens
IAAEGIHTGQF

SEQ ID NO: 7310 - protein, 12 aa, Homo sapiens
IAFLSPKVDPSL

SEQ ID NO: 7311 - protein, 10 aa, Homo sapiens
IIVSNPVDIL

SEQ ID NO: 7312 - protein, 10 aa, Homo sapiens
IVSNPVDILT

SEQ ID NO: 7313 - protein, 9 aa, Measles virus strain Edmonston-B
KIIDNTEQL

SEQ ID NO: 7314 - protein, 11 aa, Homo sapiens
KIPSRVHGSLE

SEQ ID NO: 7315 - protein, 9 aa, Measles virus strain Edmonston-B
KLIDGFFPA

SEQ ID NO: 7316 - protein, 12 aa, Homo sapiens
KNNACGIANLAS

SEQ ID NO: 7317 - protein, 12 aa, Homo sapiens
KVIPELNGKLTG

SEQ ID NO: 7318 - protein, 9 aa, Measles virus strain Edmonston-B
KVSPYLFTV

SEQ ID NO: 7319 - protein, 9 aa, Homo sapiens
LALGQDRIL

SEQ ID NO: 7320 - protein, 11 aa, Homo sapiens
LARDYAAIVFF

SEQ ID NO: 7321 - protein, 10 aa, Homo sapiens
LILAPTRELA

SEQ ID NO: 7322 - protein, 11 aa, Homo sapiens
LLERCIHPADI

SEQ ID NO: 7323 - protein, 10 aa, Homo sapiens
LLSGGLPRKC

SEQ ID NO: 7324 - protein, 12 aa, Homo sapiens
LSVADLAESIMK

SEQ ID NO: 7325 - protein, 9 aa, Homo sapiens
LTKAPVDLL

SEQ ID NO: 7326 - protein, 12 aa, Homo sapiens
LYWSLPEKPNGL

SEQ ID NO: 7327 - protein, 11 aa, Homo sapiens
NAISRIPKGQV

SEQ ID NO: 7328 - protein, 9 aa, Homo sapiens
NLEPRTGFL

SEQ ID NO: 7329 - protein, 9 aa, Homo sapiens
NLPTGIPIV

SEQ ID NO: 7330 - protein, 11 aa, Homo sapiens
QLDGLSVSLGR

SEQ ID NO: 7331 - protein, 11 aa, Homo sapiens
QLYEEEIRELQ

SEQ ID NO: 7332 - protein, 11 aa, Homo sapiens
RGTINLSTAHI

SEQ ID NO: 7333 - protein, 11 aa, Measles virus strain Edmonston-B
RQAGQEMILAV

SEQ ID NO: 7334 - protein, 12 aa, Homo sapiens
SLDMDSIIAEVK

SEQ ID NO: 7335 - protein, 12 aa, Homo sapiens
SLHTRTRSLDFR

SEQ ID NO: 7336 - protein, 11 aa, Measles virus strain Edmonston-B
SLMPEETLHQV

SEQ ID NO: 7337 - protein, 12 aa, Homo sapiens
SMAGNRLAFLPL

SEQ ID NO: 7338 - protein, 8 aa, Measles virus strain Edmonston-B
SMYRVFEV

SEQ ID NO: 7339 - protein, 10 aa, Homo sapiens
SNLKLPKGIL

SEQ ID NO: 7340 - protein, 12 aa, Homo sapiens
SQQIEESTTVVT

SEQ ID NO: 7341 - protein, 10 aa, Homo sapiens
SSVPGVRLLQ

SEQ ID NO: 7342 - protein, 9 aa, Homo sapiens
VIAQGIGKL

SEQ ID NO: 7343 - protein, 12 aa, Measles virus strain Edmonston-B
VIINDDQGLFKV

SEQ ID NO: 7344 - protein, 11 aa, Homo sapiens
VLNLGKDSNNL

SEQ ID NO: 7345 - protein, 12 aa, Homo sapiens
YISPDQLADLYK

SEQ ID NO: 7346 - protein, 12 aa, Homo sapiens
YLTPLPQPNRAL

SEQ ID NO: 7347 - protein, 10 aa, Homo sapiens
GQFKDIITKV

SEQ ID NO: 7348 - protein, 11 aa, Homo sapiens
KVWDLPSTSHV

SEQ ID NO: 7349 - protein, 10 aa, Homo sapiens
AIAELGIYPA

SEQ ID NO: 7350 - protein, 9 aa, Homo sapiens
AILDTLYEV

SEQ ID NO: 7351 - protein, 11 aa, Homo sapiens
AILGITESFQV

SEQ ID NO: 7352 - protein, 9 aa, Homo sapiens
AIMGFIGFF

SEQ ID NO: 7353 - protein, 10 aa, Homo sapiens
AIMGFIGFFV

SEQ ID NO: 7354 - protein, 9 aa, Homo sapiens
AINQFTQAL

SEQ ID NO: 7355 - protein, 11 aa, Homo sapiens
AISEVVSQTPA

SEQ ID NO: 7356 - protein, 9 aa, Homo sapiens
AITDKIFQI

SEQ ID NO: 7357 - protein, 11 aa, Homo sapiens
ALAADIDIDTV

SEQ ID NO: 7358 - protein, 9 aa, Homo sapiens
ALAAFISSV

SEQ ID NO: 7359 - protein, 10 aa, Homo sapiens
ALAALGLPGA

SEQ ID NO: 7360 - protein, 9 aa, Homo sapiens
ALAASPASV

SEQ ID NO: 7361 - protein, 12 aa, Homo sapiens
ALAAVAGGAPSV

SEQ ID NO: 7362 - protein, 10 aa, Homo sapiens
ALADDDFLTV

SEQ ID NO: 7363 - protein, 9 aa, Homo sapiens
ALADFAELI

SEQ ID NO: 7364 - protein, 9 aa, Homo sapiens
ALADIVWRA

SEQ ID NO: 7365 - protein, 9 aa, Homo sapiens
ALADLQEAV

SEQ ID NO: 7366 - protein, 11 aa, Homo sapiens
ALADLQEAVKL

SEQ ID NO: 7367 - protein, 10 aa, Homo sapiens
ALADVEVTYT

SEQ ID NO: 7368 - protein, 11 aa, Homo sapiens
ALADVEVTYTV

SEQ ID NO: 7369 - protein, 9 aa, Homo sapiens
ALADVVHEA

SEQ ID NO: 7370 - protein, 10 aa, Homo sapiens
ALAEDGPPTV

SEQ ID NO: 7371 - protein, 12 aa, Homo sapiens
ALAEGEPEGPWM

SEQ ID NO: 7372 - protein, 9 aa, Homo sapiens
ALAEKTSHV

SEQ ID NO: 7373 - protein, 10 aa, Homo sapiens
ALAELENIEV

SEQ ID NO: 7374 - protein, 9 aa, Homo sapiens
ALAELFGLL

SEQ ID NO: 7375 - protein, 10 aa, Homo sapiens
ALAELFGLLV

SEQ ID NO: 7376 - protein, 12 aa, Homo sapiens
ALAELSTAMHQV

SEQ ID NO: 7377 - protein, 10 aa, Homo sapiens
ALAELYEDEV

SEQ ID NO: 7378 - protein, 10 aa, Homo sapiens
ALAENSGVKA

SEQ ID NO: 7379 - protein, 10 aa, Homo sapiens
ALAEPLIQNV

SEQ ID NO: 7380 - protein, 11 aa, Homo sapiens
ALAEQHAVQEL

SEQ ID NO: 7381 - protein, 9 aa, Homo sapiens
ALAFDLSKV

SEQ ID NO: 7382 - protein, 9 aa, Homo sapiens
ALAGAPYQA

SEQ ID NO: 7383 - protein, 9 aa, Homo sapiens
ALAGVSFEI

SEQ ID NO: 7384 - protein, 9 aa, Homo sapiens
ALALPAPAL

SEQ ID NO: 7385 - protein, 10 aa, Homo sapiens
ALANQKLYSV

SEQ ID NO: 7386 - protein, 9 aa, Homo sapiens
ALANVNIGS

SEQ ID NO: 7387 - protein, 9 aa, Homo sapiens
ALAPLAIPS

SEQ ID NO: 7388 - protein, 10 aa, Homo sapiens
ALAPLAIPSA

SEQ ID NO: 7389 - protein, 9 aa, Homo sapiens
ALAQKNVKL

SEQ ID NO: 7390 - protein, 10 aa, Homo sapiens
ALASLKKYGV

SEQ ID NO: 7391 - protein, 9 aa, Homo sapiens
ALDASILNV

SEQ ID NO: 7392 - protein, 8 aa, Homo sapiens
ALDDFSIS

SEQ ID NO: 7393 - protein, 9 aa, Homo sapiens
ALDDFSISV

SEQ ID NO: 7394 - protein, 9 aa, Homo sapiens
ALDDIEWFV

SEQ ID NO: 7395 - protein, 9 aa, Homo sapiens
ALDDISESI

SEQ ID NO: 7396 - protein, 10 aa, Homo sapiens
ALDEAQGVGL

SEQ ID NO: 7397 - protein, 9 aa, Homo sapiens
ALDEEYLKV

SEQ ID NO: 7398 - protein, 10 aa, Homo sapiens
ALDELASLQV

SEQ ID NO: 7399 - protein, 9 aa, Homo sapiens
ALDEVIFSL

SEQ ID NO: 7400 - protein, 9 aa, Homo sapiens
ALDFEQEMA

SEQ ID NO: 7401 - protein, 11 aa, Homo sapiens
ALDGAAGTVYL

SEQ ID NO: 7402 - protein, 9 aa, Homo sapiens
ALDIAENEM

SEQ ID NO: 7403 - protein, 9 aa, Homo sapiens
ALDLAPSSL

SEQ ID NO: 7404 - protein, 9 aa, Homo sapiens
ALDNFLDKL

SEQ ID NO: 7405 - protein, 9 aa, Homo sapiens
ALDPMSVLL

SEQ ID NO: 7406 - protein, 9 aa, Homo sapiens
ALDSASILL

SEQ ID NO: 7407 - protein, 9 aa, Homo sapiens
ALDTKGPEI

SEQ ID NO: 7408 - protein, 9 aa, Homo sapiens
ALDTSNVMV

SEQ ID NO: 7409 - protein, 9 aa, Homo sapiens
ALEEKLENV

SEQ ID NO: 7410 - protein, 10 aa, Homo sapiens
ALEELGTLQV

SEQ ID NO: 7411 - protein, 9 aa, Homo sapiens
ALEKLLPHI

SEQ ID NO: 7412 - protein, 12 aa, Homo sapiens
ALFAPRDPIPYL

SEQ ID NO: 7413 - protein, 11 aa, Homo sapiens
ALFASGLIHRV

SEQ ID NO: 7414 - protein, 9 aa, Homo sapiens
ALFEDGPEA

SEQ ID NO: 7415 - protein, 12 aa, Homo sapiens
ALFEDGPEAEAV

SEQ ID NO: 7416 - protein, 10 aa, Homo sapiens
ALFEEVPELL

SEQ ID NO: 7417 - protein, 11 aa, Homo sapiens
ALFEEVPELLT

SEQ ID NO: 7418 - protein, 10 aa, Homo sapiens
ALFGVVFPHV

SEQ ID NO: 7419 - protein, 10 aa, Homo sapiens
ALFILPFVSV

SEQ ID NO: 7420 - protein, 10 aa, Homo sapiens
ALFNRLVPSV

SEQ ID NO: 7421 - protein, 8 aa, Homo sapiens
ALFPGVAL

SEQ ID NO: 7422 - protein, 10 aa, Homo sapiens
ALFPHLLQPV

SEQ ID NO: 7423 - protein, 12 aa, Homo sapiens
ALFPHLLQPVLW

SEQ ID NO: 7424 - protein, 8 aa, Homo sapiens
ALFQRPPL

SEQ ID NO: 7425 - protein, 9 aa, Homo sapiens
ALFTFSPLT

SEQ ID NO: 7426 - protein, 10 aa, Homo sapiens
ALFTFSPLTV

SEQ ID NO: 7427 - protein, 12 aa, Homo sapiens
ALGDGALFYFGL

SEQ ID NO: 7428 - protein, 11 aa, Homo sapiens
ALGETFIRYFV

SEQ ID NO: 7429 - protein, 9 aa, Homo sapiens
ALGIANPLL

SEQ ID NO: 7430 - protein, 8 aa, Homo sapiens
ALGTVTNV

SEQ ID NO: 7431 - protein, 9 aa, Homo sapiens
ALHDILTEI

SEQ ID NO: 7432 - protein, 9 aa, Homo sapiens
ALHHKDIAL

SEQ ID NO: 7433 - protein, 12 aa, Homo sapiens
ALIAAQYSGAQV

SEQ ID NO: 7434 - protein, 9 aa, Homo sapiens
ALIEGVGIL

SEQ ID NO: 7435 - protein, 9 aa, Homo sapiens
ALIEVLQPL

SEQ ID NO: 7436 - protein, 10 aa, Homo sapiens
ALIEVLQPLI

SEQ ID NO: 7437 - protein, 11 aa, Homo sapiens
ALIEVLQPLIA

SEQ ID NO: 7438 - protein, 12 aa, Homo sapiens
ALIEVLQPLIAE

SEQ ID NO: 7439 - protein, 12 aa, Homo sapiens
ALIEVPDGFTAV

SEQ ID NO: 7440 - protein, 10 aa, Homo sapiens
ALIKAAGVNV

SEQ ID NO: 7441 - protein, 9 aa, Homo sapiens
ALIKQLFEA

SEQ ID NO: 7442 - protein, 11 aa, Homo sapiens
ALILHDDEVTV

SEQ ID NO: 7443 - protein, 11 aa, Homo sapiens
ALKEEIGNVQL

SEQ ID NO: 7444 - protein, 10 aa, Homo sapiens
ALLADELITV

SEQ ID NO: 7445 - protein, 10 aa, Homo sapiens
ALLAEGITWV

SEQ ID NO: 7446 - protein, 11 aa, Homo sapiens
ALLDAAGVASL

SEQ ID NO: 7447 - protein, 12 aa, Homo sapiens
ALLDAAGVASLL

SEQ ID NO: 7448 - protein, 8 aa, Homo sapiens
ALLDEIST

SEQ ID NO: 7449 - protein, 12 aa, Homo sapiens
ALLDEQQVNVLL

SEQ ID NO: 7450 - protein, 8 aa, Homo sapiens
ALLDEVIM

SEQ ID NO: 7451 - protein, 10 aa, Homo sapiens
ALLDFYMKNI

SEQ ID NO: 7452 - protein, 10 aa, Homo sapiens
ALLDLFSPSV

SEQ ID NO: 7453 - protein, 12 aa, Homo sapiens
ALLDLFSPSVTV

SEQ ID NO: 7454 - protein, 8 aa, Homo sapiens
ALLDRIVS

SEQ ID NO: 7455 - protein, 9 aa, Homo sapiens
ALLDRYFEA

SEQ ID NO: 7456 - protein, 9 aa, Homo sapiens
ALLDSFITI

SEQ ID NO: 7457 - protein, 10 aa, Homo sapiens
ALLDVTPNAV

SEQ ID NO: 7458 - protein, 10 aa, Homo sapiens
ALLEEAEQLL

SEQ ID NO: 7459 - protein, 12 aa, Homo sapiens
ALLEEFPDKGFF

SEQ ID NO: 7460 - protein, 10 aa, Homo sapiens
ALLELAEELL

SEQ ID NO: 7461 - protein, 9 aa, Homo sapiens
ALLELLERL

SEQ ID NO: 7462 - protein, 9 aa, Homo sapiens
ALLETMFGV

SEQ ID NO: 7463 - protein, 11 aa, Homo sapiens
ALLGEEDEEAL

SEQ ID NO: 7464 - protein, 9 aa, Homo sapiens
ALLGFLVLV

SEQ ID NO: 7465 - protein, 9 aa, Homo sapiens
ALLGKIEKV

SEQ ID NO: 7466 - protein, 11 aa, Homo sapiens
ALLGKIEKVRV

SEQ ID NO: 7467 - protein, 10 aa, Homo sapiens
ALLGMDLLRL

SEQ ID NO: 7468 - protein, 10 aa, Homo sapiens
ALLGRIPSAV

SEQ ID NO: 7469 - protein, 9 aa, Homo sapiens
ALLGYLQEV

SEQ ID NO: 7470 - protein, 9 aa, Homo sapiens
ALLLHLPAL

SEQ ID NO: 7471 - protein, 9 aa, Homo sapiens
ALLLPPVTL

SEQ ID NO: 7472 - protein, 9 aa, Homo sapiens
ALLNETESV

SEQ ID NO: 7473 - protein, 8 aa, Homo sapiens
ALLNGEYL

SEQ ID NO: 7474 - protein, 9 aa, Homo sapiens
ALLNQHYQV

SEQ ID NO: 7475 - protein, 11 aa, Homo sapiens
ALLQELEDLEL

SEQ ID NO: 7476 - protein, 9 aa, Homo sapiens
ALLQRQFDV

SEQ ID NO: 7477 - protein, 9 aa, Homo sapiens
ALLRTVVSV

SEQ ID NO: 7478 - protein, 9 aa, Homo sapiens
ALLSAAFLL

SEQ ID NO: 7479 - protein, 9 aa, Homo sapiens
ALLSGIVSI

SEQ ID NO: 7480 - protein, 9 aa, Homo sapiens
ALLSSGFSL

SEQ ID NO: 7481 - protein, 9 aa, Homo sapiens
ALLTAVTNV

SEQ ID NO: 7482 - protein, 10 aa, Homo sapiens
ALLTGIISKA

SEQ ID NO: 7483 - protein, 9 aa, Homo sapiens
ALLVTQQLV

SEQ ID NO: 7484 - protein, 10 aa, Homo sapiens
ALMDGKVYDI

SEQ ID NO: 7485 - protein, 9 aa, Homo sapiens
ALMDLVQGV

SEQ ID NO: 7486 - protein, 11 aa, Homo sapiens
ALMEDTGRQML

SEQ ID NO: 7487 - protein, 9 aa, Homo sapiens
ALMELDKGL

SEQ ID NO: 7488 - protein, 11 aa, Homo sapiens
ALMEVNLLSGF

SEQ ID NO: 7489 - protein, 11 aa, Homo sapiens
ALMGSPQLVAA

SEQ ID NO: 7490 - protein, 9 aa, Homo sapiens
ALMKAVATV

SEQ ID NO: 7491 - protein, 11 aa, Homo sapiens
ALMKAVATVGP

SEQ ID NO: 7492 - protein, 12 aa, Homo sapiens
ALMNGSESRFFV

SEQ ID NO: 7493 - protein, 10 aa, Homo sapiens
ALMTLGPAVV

SEQ ID NO: 7494 - protein, 11 aa, Homo sapiens
ALNDNLEKGLL

SEQ ID NO: 7495 - protein, 9 aa, Homo sapiens
ALNDSVKTV

SEQ ID NO: 7496 - protein, 9 aa, Homo sapiens
ALNEDIVRV

SEQ ID NO: 7497 - protein, 9 aa, Homo sapiens
ALNENIDRV

SEQ ID NO: 7498 - protein, 9 aa, Homo sapiens
ALNPADITV

SEQ ID NO: 7499 - protein, 9 aa, Homo sapiens
ALNPESNTA

SEQ ID NO: 7500 - protein, 9 aa, Homo sapiens
ALNRISPML

SEQ ID NO: 7501 - protein, 11 aa, Homo sapiens
ALNSPHSESFV

SEQ ID NO: 7502 - protein, 11 aa, Homo sapiens
ALNVEPDGTGL

SEQ ID NO: 7503 - protein, 11 aa, Homo sapiens
ALPAGWKPLFV

SEQ ID NO: 7504 - protein, 9 aa, Homo sapiens
ALPEMEIHL

SEQ ID NO: 7505 - protein, 11 aa, Homo sapiens
ALPGPFPGGRV

SEQ ID NO: 7506 - protein, 10 aa, Homo sapiens
ALPRLTPPVL

SEQ ID NO: 7507 - protein, 8 aa, Homo sapiens
ALQEELQL

SEQ ID NO: 7508 - protein, 11 aa, Homo sapiens
ALQEFGPISYV

SEQ ID NO: 7509 - protein, 12 aa, Homo sapiens
ALQEFGPISYVV

SEQ ID NO: 7510 - protein, 8 aa, Homo sapiens
ALQEISFW

SEQ ID NO: 7511 - protein, 9 aa, Homo sapiens
ALQEISFWL

SEQ ID NO: 7512 - protein, 9 aa, Homo sapiens
ALQEVLKTA

SEQ ID NO: 7513 - protein, 11 aa, Homo sapiens
ALQEVLKTALI

SEQ ID NO: 7514 - protein, 10 aa, Homo sapiens
ALQFLEEVKV

SEQ ID NO: 7515 - protein, 12 aa, Homo sapiens
ALQGAHAWILQV

SEQ ID NO: 7516 - protein, 9 aa, Homo sapiens
ALQGIIHSI

SEQ ID NO: 7517 - protein, 11 aa, Homo sapiens
ALQLQDFYQEV

SEQ ID NO: 7518 - protein, 9 aa, Homo sapiens
ALQWVIPYI

SEQ ID NO: 7519 - protein, 10 aa, Homo sapiens
ALRESPLHPA

SEQ ID NO: 7520 - protein, 12 aa, Homo sapiens
ALSDETKNNWEV

SEQ ID NO: 7521 - protein, 8 aa, Homo sapiens
ALSDLEIT

SEQ ID NO: 7522 - protein, 9 aa, Homo sapiens
ALSEALTEL

SEQ ID NO: 7523 - protein, 11 aa, Homo sapiens
ALSEFGSKIIL

SEQ ID NO: 7524 - protein, 9 aa, Homo sapiens
ALSEGNPGI

SEQ ID NO: 7525 - protein, 11 aa, Homo sapiens
ALSGHLGEVLI

SEQ ID NO: 7526 - protein, 10 aa, Homo sapiens
ALSGLDMVGV

SEQ ID NO: 7527 - protein, 9 aa, Homo sapiens
ALSGTLSGV

SEQ ID NO: 7528 - protein, 10 aa, Homo sapiens
ALSKQEMASA

SEQ ID NO: 7529 - protein, 9 aa, Homo sapiens
ALSNVIHKV

SEQ ID NO: 7530 - protein, 9 aa, Homo sapiens
ALSPNNHEV

SEQ ID NO: 7531 - protein, 10 aa, Homo sapiens
ALSRQEMQEV

SEQ ID NO: 7532 - protein, 9 aa, Homo sapiens
ALSTATATV

SEQ ID NO: 7533 - protein, 9 aa, Homo sapiens
ALTEIQEFI

SEQ ID NO: 7534 - protein, 9 aa, Homo sapiens
ALTELGYNV

SEQ ID NO: 7535 - protein, 9 aa, Homo sapiens
ALTGHLEEV

SEQ ID NO: 7536 - protein, 10 aa, Homo sapiens
ALTGIPLPLI

SEQ ID NO: 7537 - protein, 9 aa, Homo sapiens
ALTGRIQEA

SEQ ID NO: 7538 - protein, 9 aa, Homo sapiens
ALTLATETV

SEQ ID NO: 7539 - protein, 9 aa, Homo sapiens
ALTNVDTPL

SEQ ID NO: 7540 - protein, 10 aa, Homo sapiens
ALTQTGGPHV

SEQ ID NO: 7541 - protein, 9 aa, Homo sapiens
ALTSLELEL

SEQ ID NO: 7542 - protein, 10 aa, Homo sapiens
ALVLGPLKSV

SEQ ID NO: 7543 - protein, 10 aa, Homo sapiens
ALVSKGLATV

SEQ ID NO: 7544 - protein, 9 aa, Homo sapiens
ALWAKSPGV

SEQ ID NO: 7545 - protein, 10 aa, Homo sapiens
ALWAKSPGVL

SEQ ID NO: 7546 - protein, 11 aa, Homo sapiens
ALWAKSPGVLA

SEQ ID NO: 7547 - protein, 11 aa, Homo sapiens
ALWDIETGQQT

SEQ ID NO: 7548 - protein, 12 aa, Homo sapiens
ALWDPENLEEPM

SEQ ID NO: 7549 - protein, 10 aa, Homo sapiens
ALWDPGPEAA

SEQ ID NO: 7550 - protein, 10 aa, Homo sapiens
ALWEETSFQL

SEQ ID NO: 7551 - protein, 9 aa, Homo sapiens
ALWEKNTHL

SEQ ID NO: 7552 - protein, 9 aa, Homo sapiens
ALWGGPISL

SEQ ID NO: 7553 - protein, 11 aa, Homo sapiens
ALWHDAENQTV

SEQ ID NO: 7554 - protein, 12 aa, Homo sapiens
ALWHDAENQTVV

SEQ ID NO: 7555 - protein, 11 aa, Homo sapiens
ALWHVPEHAVV

SEQ ID NO: 7556 - protein, 12 aa, Homo sapiens
ALWHVPEHAVVL

SEQ ID NO: 7557 - protein, 9 aa, Homo sapiens
ALYAMEIKV

SEQ ID NO: 7558 - protein, 9 aa, Homo sapiens
ALYDATYET

SEQ ID NO: 7559 - protein, 12 aa, Homo sapiens
ALYDENTKLWYA

SEQ ID NO: 7560 - protein, 11 aa, Homo sapiens
ALYEDPPDQKT

SEQ ID NO: 7561 - protein, 9 aa, Homo sapiens
ALYEDRYLL

SEQ ID NO: 7562 - protein, 11 aa, Homo sapiens
ALYEDRYLLGT

SEQ ID NO: 7563 - protein, 11 aa, Homo sapiens
ALYEELDLPAV

SEQ ID NO: 7564 - protein, 12 aa, Homo sapiens
ALYEELDLPAVF

SEQ ID NO: 7565 - protein, 10 aa, Homo sapiens
ALYETELADA

SEQ ID NO: 7566 - protein, 11 aa, Homo sapiens
ALYGKTEVVRL

SEQ ID NO: 7567 - protein, 10 aa, Homo sapiens
ALYGSVPVLL

SEQ ID NO: 7568 - protein, 9 aa, Homo sapiens
ALYNALDKV

SEQ ID NO: 7569 - protein, 9 aa, Homo sapiens
ALYNWLIQV

SEQ ID NO: 7570 - protein, 9 aa, Homo sapiens
ALYYNPHLL

SEQ ID NO: 7571 - protein, 10 aa, Homo sapiens
AMFYGDLAEV

SEQ ID NO: 7572 - protein, 9 aa, Homo sapiens
AMGEKSFSV

SEQ ID NO: 7573 - protein, 9 aa, Homo sapiens
AMLAKTAGV

SEQ ID NO: 7574 - protein, 9 aa, Homo sapiens
AMLEEVNYI

SEQ ID NO: 7575 - protein, 9 aa, Homo sapiens
AMLGQAEEV

SEQ ID NO: 7576 - protein, 9 aa, Homo sapiens
AMMHALEVL

SEQ ID NO: 7577 - protein, 9 aa, Homo sapiens
AMNFHEVLA

SEQ ID NO: 7578 - protein, 9 aa, Homo sapiens
AMNGKSFSV

SEQ ID NO: 7579 - protein, 11 aa, Homo sapiens
AMNYEGSPIKV

SEQ ID NO: 7580 - protein, 12 aa, Homo sapiens
AMQEFMILPVGA

SEQ ID NO: 7581 - protein, 9 aa, Homo sapiens
AMRPSEEHV

SEQ ID NO: 7582 - protein, 9 aa, Homo sapiens
AMSPTAAAV

SEQ ID NO: 7583 - protein, 8 aa, Homo sapiens
AMSSKFFL

SEQ ID NO: 7584 - protein, 9 aa, Homo sapiens
AMSSKFFLV

SEQ ID NO: 7585 - protein, 11 aa, Homo sapiens
AMVEMADGYAV

SEQ ID NO: 7586 - protein, 10 aa, Homo sapiens
AMVWEGLNVV

SEQ ID NO: 7587 - protein, 10 aa, Homo sapiens
AMWEVNEAFS

SEQ ID NO: 7588 - protein, 11 aa, Homo sapiens
AMWEVNEAFSL

SEQ ID NO: 7589 - protein, 12 aa, Homo sapiens
AMWEVNEAFSLV

SEQ ID NO: 7590 - protein, 10 aa, Homo sapiens
AMYESELERA

SEQ ID NO: 7591 - protein, 9 aa, Homo sapiens
AMYSVEITV

SEQ ID NO: 7592 - protein, 10 aa, Homo sapiens
AQANGWGVMV

SEQ ID NO: 7593 - protein, 9 aa, Homo sapiens
AQHLGESTV

SEQ ID NO: 7594 - protein, 10 aa, Homo sapiens
AQLSEIQTQI

SEQ ID NO: 7595 - protein, 9 aa, Homo sapiens
AQSELDIYL

SEQ ID NO: 7596 - protein, 9 aa, Homo sapiens
AQVEAVHKV

SEQ ID NO: 7597 - protein, 10 aa, Homo sapiens
AQYSGAQVRV

SEQ ID NO: 7598 - protein, 9 aa, Homo sapiens
AVDAVIAEL

SEQ ID NO: 7599 - protein, 10 aa, Homo sapiens
AVFGEEGLTL

SEQ ID NO: 7600 - protein, 12 aa, Homo sapiens
AVFGEEGLTLNL

SEQ ID NO: 7601 - protein, 12 aa, Homo sapiens
AVFGKYGRIVEV

SEQ ID NO: 7602 - protein, 10 aa, Homo sapiens
AVFPFQPGSV

SEQ ID NO: 7603 - protein, 9 aa, Homo sapiens
AVIGAVVDV

SEQ ID NO: 7604 - protein, 9 aa, Homo sapiens
AVLDNPYPV

SEQ ID NO: 7605 - protein, 9 aa, Homo sapiens
AVLPFSPAL

SEQ ID NO: 7606 - protein, 9 aa, Homo sapiens
AVMGIVSEV

SEQ ID NO: 7607 - protein, 10 aa, Homo sapiens
AVSEEQQPAL

SEQ ID NO: 7608 - protein, 11 aa, Homo sapiens
AVWSGVNVAGV

SEQ ID NO: 7609 - protein, 10 aa, Homo sapiens
AVYEGHVSCV

SEQ ID NO: 7610 - protein, 9 aa, Homo sapiens
AVYETDVFV

SEQ ID NO: 7611 - protein, 9 aa, Homo sapiens
CLYGNVEKV

SEQ ID NO: 7612 - protein, 9 aa, Homo sapiens
DLATYINMI

SEQ ID NO: 7613 - protein, 12 aa, Homo sapiens
EAFDLDPAQWGV

SEQ ID NO: 7614 - protein, 11 aa, Homo sapiens
ELLEGKVLPGV

SEQ ID NO: 7615 - protein, 10 aa, Homo sapiens
FAPEEISAMV

SEQ ID NO: 7616 - protein, 11 aa, Homo sapiens
FAPEEISAMVL

SEQ ID NO: 7617 - protein, 9 aa, Homo sapiens
FAPSPTPAV

SEQ ID NO: 7618 - protein, 9 aa, Homo sapiens
FAVQFHPEV

SEQ ID NO: 7619 - protein, 9 aa, Homo sapiens
FGAEAKLEV

SEQ ID NO: 7620 - protein, 9 aa, Homo sapiens
FGANAILGV

SEQ ID NO: 7621 - protein, 11 aa, Homo sapiens
FGIGGDGTQHV

SEQ ID NO: 7622 - protein, 10 aa, Homo sapiens
FGNEVIPVTV

SEQ ID NO: 7623 - protein, 10 aa, Homo sapiens
FGVTIDFDTV

SEQ ID NO: 7624 - protein, 9 aa, Homo sapiens
FIADLVVGL

SEQ ID NO: 7625 - protein, 9 aa, Homo sapiens
FIADVVEKI

SEQ ID NO: 7626 - protein, 9 aa, Homo sapiens
FIADVVEKT

SEQ ID NO: 7627 - protein, 9 aa, Homo sapiens
FIASVNTLV

SEQ ID NO: 7628 - protein, 9 aa, Homo sapiens
FIDEEVKLI

SEQ ID NO: 7629 - protein, 10 aa, Homo sapiens
FIDEGVNIGL

SEQ ID NO: 7630 - protein, 12 aa, Homo sapiens
FIDEGVNIGLEV

SEQ ID NO: 7631 - protein, 11 aa, Homo sapiens
FIDGDLIESFL

SEQ ID NO: 7632 - protein, 9 aa, Homo sapiens
FIDKKPTSA

SEQ ID NO: 7633 - protein, 8 aa, Homo sapiens
FIDLNYMV

SEQ ID NO: 7634 - protein, 10 aa, Homo sapiens
FIDLNYMVYM

SEQ ID NO: 7635 - protein, 10 aa, Homo sapiens
FIDSNPNQPL

SEQ ID NO: 7636 - protein, 11 aa, Homo sapiens
FIDSNPNQPLV

SEQ ID NO: 7637 - protein, 9 aa, Homo sapiens
FIEALLPHV

SEQ ID NO: 7638 - protein, 9 aa, Homo sapiens
FIEKLVPLL

SEQ ID NO: 7639 - protein, 9 aa, Homo sapiens
FIFWAPESA

SEQ ID NO: 7640 - protein, 11 aa, Homo sapiens
FIFWAPESAPL

SEQ ID NO: 7641 - protein, 9 aa, Homo sapiens
FIGEGEPHV

SEQ ID NO: 7642 - protein, 9 aa, Homo sapiens
FIGKVVNPT

SEQ ID NO: 7643 - protein, 10 aa, Homo sapiens
FIGNGVVIHL

SEQ ID NO: 7644 - protein, 9 aa, Homo sapiens
FIGNLPHEV

SEQ ID NO: 7645 - protein, 8 aa, Homo sapiens
FIGYPITL

SEQ ID NO: 7646 - protein, 9 aa, Homo sapiens
FIHDIDREL

SEQ ID NO: 7647 - protein, 12 aa, Homo sapiens
FILEEAITGDFA

SEQ ID NO: 7648 - protein, 10 aa, Homo sapiens
FILKHTGPGI

SEQ ID NO: 7649 - protein, 10 aa, Homo sapiens
FILKHTGPGL

SEQ ID NO: 7650 - protein, 9 aa, Homo sapiens
FIMEELDKV

SEQ ID NO: 7651 - protein, 9 aa, Homo sapiens
FIMEGGAMV

SEQ ID NO: 7652 - protein, 10 aa, Homo sapiens
FIMEGGAMVL

SEQ ID NO: 7653 - protein, 11 aa, Homo sapiens
FIMEGGAMVLA

SEQ ID NO: 7654 - protein, 9 aa, Homo sapiens
FININSLRL

SEQ ID NO: 7655 - protein, 9 aa, Homo sapiens
FIQSIISTV

SEQ ID NO: 7656 - protein, 9 aa, Homo sapiens
FIRELISNA

SEQ ID NO: 7657 - protein, 9 aa, Homo sapiens
FISGDKVNV

SEQ ID NO: 7658 - protein, 10 aa, Homo sapiens
FISVQSPPTV

SEQ ID NO: 7659 - protein, 10 aa, Homo sapiens
FIVNTNVPRA

SEQ ID NO: 7660 - protein, 11 aa, Homo sapiens
FIVSEDGLIVT

SEQ ID NO: 7661 - protein, 11 aa, Homo sapiens
FIWPAIQSSAL

SEQ ID NO: 7662 - protein, 10 aa, Homo sapiens
FIYPAQNPEL

SEQ ID NO: 7663 - protein, 9 aa, Homo sapiens
FLAALPPAI

SEQ ID NO: 7664 - protein, 9 aa, Homo sapiens
FLADGKVFT

SEQ ID NO: 7665 - protein, 10 aa, Homo sapiens
FLADGKVFTT

SEQ ID NO: 7666 - protein, 11 aa, Homo sapiens
FLADGKVFTTG

SEQ ID NO: 7667 - protein, 12 aa, Homo sapiens
FLADGKVFTTGF

SEQ ID NO: 7668 - protein, 9 aa, Homo sapiens
FLADLLVPT

SEQ ID NO: 7669 - protein, 11 aa, Homo sapiens
FLADLLVPTKA

SEQ ID NO: 7670 - protein, 11 aa, Homo sapiens
FLADLMDNSEL

SEQ ID NO: 7671 - protein, 8 aa, Homo sapiens
FLADPSAF

SEQ ID NO: 7672 - protein, 9 aa, Homo sapiens
FLADPSAFV

SEQ ID NO: 7673 - protein, 12 aa, Homo sapiens
FLADPSAFVAAA

SEQ ID NO: 7674 - protein, 10 aa, Homo sapiens
FLAEAELLNL

SEQ ID NO: 7675 - protein, 12 aa, Homo sapiens
FLAEDGGTGGGS

SEQ ID NO: 7676 - protein, 9 aa, Homo sapiens
FLAEEMSKL

SEQ ID NO: 7677 - protein, 12 aa, Homo sapiens
FLAEGIVNGHTL

SEQ ID NO: 7678 - protein, 11 aa, Homo sapiens
FLAEGTAIKDL

SEQ ID NO: 7679 - protein, 12 aa, Homo sapiens
FLAEGTAIKDLK

SEQ ID NO: 7680 - protein, 9 aa, Homo sapiens
FLAENVKQV

SEQ ID NO: 7681 - protein, 10 aa, Homo sapiens
FLAFPSPEKL

SEQ ID NO: 7682 - protein, 12 aa, Homo sapiens
FLAFTTHPSQFL

SEQ ID NO: 7683 - protein, 8 aa, Homo sapiens
FLAFVEKV

SEQ ID NO: 7684 - protein, 9 aa, Homo sapiens
FLAIDAKLT

SEQ ID NO: 7685 - protein, 11 aa, Homo sapiens
FLANEAKGTKV

SEQ ID NO: 7686 - protein, 12 aa, Homo sapiens
FLANIGTSVQNV

SEQ ID NO: 7687 - protein, 9 aa, Homo sapiens
FLAPELPAV

SEQ ID NO: 7688 - protein, 10 aa, Homo sapiens
FLAPELPAVS

SEQ ID NO: 7689 - protein, 11 aa, Homo sapiens
FLAPELPAVSE

SEQ ID NO: 7690 - protein, 12 aa, Homo sapiens
FLAPELPAVSEF

SEQ ID NO: 7691 - protein, 8 aa, Homo sapiens
FLAPGFTL

SEQ ID NO: 7692 - protein, 11 aa, Homo sapiens
FLAPGFTLQNV

SEQ ID NO: 7693 - protein, 12 aa, Homo sapiens
FLAPGFTLQNVG

SEQ ID NO: 7694 - protein, 10 aa, Homo sapiens
FLAPKPAPVL

SEQ ID NO: 7695 - protein, 10 aa, Homo sapiens
FLAPLKPVAI

SEQ ID NO: 7696 - protein, 11 aa, Homo sapiens
FLAQAEVYKEL

SEQ ID NO: 7697 - protein, 11 aa, Homo sapiens
FLAQGTLRPDL

SEQ ID NO: 7698 - protein, 9 aa, Homo sapiens
FLAQKPAPL

SEQ ID NO: 7699 - protein, 10 aa, Homo sapiens
FLAQKPAPLL

SEQ ID NO: 7700 - protein, 9 aa, Homo sapiens
FLAQRISSI

SEQ ID NO: 7701 - protein, 10 aa, Homo sapiens
FLASLDGEKL

SEQ ID NO: 7702 - protein, 9 aa, Homo sapiens
FLASLNPKT

SEQ ID NO: 7703 - protein, 10 aa, Homo sapiens
FLASPEYVNL

SEQ ID NO: 7704 - protein, 8 aa, Homo sapiens
FLASVSTV

SEQ ID NO: 7705 - protein, 9 aa, Homo sapiens
FLASVSTVL

SEQ ID NO: 7706 - protein, 10 aa, Homo sapiens
FLASVSTVLT

SEQ ID NO: 7707 - protein, 9 aa, Homo sapiens
FLATEGDHL

SEQ ID NO: 7708 - protein, 11 aa, Homo sapiens
FLATEGDHLQL

SEQ ID NO: 7709 - protein, 9 aa, Homo sapiens
FLATKFSTV

SEQ ID NO: 7710 - protein, 9 aa, Homo sapiens
FLAVKPHII

SEQ ID NO: 7711 - protein, 9 aa, Homo sapiens
FLDATLTSV

SEQ ID NO: 7712 - protein, 10 aa, Homo sapiens
FLDAYAEHKL

SEQ ID NO: 7713 - protein, 10 aa, Homo sapiens
FLDDFIACVP

SEQ ID NO: 7714 - protein, 10 aa, Homo sapiens
FLDDGNQMLL

SEQ ID NO: 7715 - protein, 12 aa, Homo sapiens
FLDDLGNAKSHL

SEQ ID NO: 7716 - protein, 9 aa, Homo sapiens
FLDDLSQKL

SEQ ID NO: 7717 - protein, 10 aa, Homo sapiens
FLDDNQIITS

SEQ ID NO: 7718 - protein, 10 aa, Homo sapiens
FLDDNQIVTS

SEQ ID NO: 7719 - protein, 10 aa, Homo sapiens
FLDDSTLRFV

SEQ ID NO: 7720 - protein, 9 aa, Homo sapiens
FLDEAAARL

SEQ ID NO: 7721 - protein, 10 aa, Homo sapiens
FLDEAAARLL

SEQ ID NO: 7722 - protein, 11 aa, Homo sapiens
FLDEAAARLLT

SEQ ID NO: 7723 - protein, 12 aa, Homo sapiens
FLDEAAARLLTV

SEQ ID NO: 7724 - protein, 9 aa, Homo sapiens
FLDEDLKVA

SEQ ID NO: 7725 - protein, 10 aa, Homo sapiens
FLDEHHSVNF

SEQ ID NO: 7726 - protein, 9 aa, Homo sapiens
FLDELAQKL

SEQ ID NO: 7727 - protein, 9 aa, Homo sapiens
FLDELEDEA

SEQ ID NO: 7728 - protein, 11 aa, Homo sapiens
FLDELEDEAKA

SEQ ID NO: 7729 - protein, 9 aa, Homo sapiens
FLDELGFLE

SEQ ID NO: 7730 - protein, 10 aa, Homo sapiens
FLDELGFLEI

SEQ ID NO: 7731 - protein, 11 aa, Homo sapiens
FLDELGFLEIE

SEQ ID NO: 7732 - protein, 12 aa, Homo sapiens
FLDELGFLEIET

SEQ ID NO: 7733 - protein, 11 aa, Homo sapiens
FLDENVHFFHT

SEQ ID NO: 7734 - protein, 9 aa, Homo sapiens
FLDEQELEA

SEQ ID NO: 7735 - protein, 10 aa, Homo sapiens
FLDEQELEAL

SEQ ID NO: 7736 - protein, 11 aa, Homo sapiens
FLDEQELEALF

SEQ ID NO: 7737 - protein, 12 aa, Homo sapiens
FLDEQELEALFT

SEQ ID NO: 7738 - protein, 9 aa, Homo sapiens
FLDEVLFIE

SEQ ID NO: 7739 - protein, 11 aa, Homo sapiens
FLDEVSRQQEL

SEQ ID NO: 7740 - protein, 9 aa, Homo sapiens
FLDFIGHIL

SEQ ID NO: 7741 - protein, 11 aa, Homo sapiens
FLDGNELTLAD

SEQ ID NO: 7742 - protein, 9 aa, Homo sapiens
FLDGRIVFT

SEQ ID NO: 7743 - protein, 12 aa, Homo sapiens
FLDISRPKMQEV

SEQ ID NO: 7744 - protein, 10 aa, Homo sapiens
FLDKALELNM

SEQ ID NO: 7745 - protein, 11 aa, Homo sapiens
FLDKALELNML

SEQ ID NO: 7746 - protein, 11 aa, Homo sapiens
FLDKMPEANQL

SEQ ID NO: 7747 - protein, 10 aa, Homo sapiens
FLDKPEDVLL

SEQ ID NO: 7748 - protein, 9 aa, Homo sapiens
FLDKVLVAA

SEQ ID NO: 7749 - protein, 8 aa, Homo sapiens
FLDLGPWA

SEQ ID NO: 7750 - protein, 9 aa, Homo sapiens
FLDLGPWAV

SEQ ID NO: 7751 - protein, 9 aa, Homo sapiens
FLDLWNKFL

SEQ ID NO: 7752 - protein, 9 aa, Homo sapiens
FLDPDRHFL

SEQ ID NO: 7753 - protein, 11 aa, Homo sapiens
FLDPKVAQRVL

SEQ ID NO: 7754 - protein, 12 aa, Homo sapiens
FLDPLAGAVTKT

SEQ ID NO: 7755 - protein, 9 aa, Homo sapiens
FLDPNARPL

SEQ ID NO: 7756 - protein, 10 aa, Homo sapiens
FLDPNARPLV

SEQ ID NO: 7757 - protein, 12 aa, Homo sapiens
FLDPNARPLVPE

SEQ ID NO: 7758 - protein, 10 aa, Homo sapiens
FLDPNTLERL

SEQ ID NO: 7759 - protein, 11 aa, Homo sapiens
FLDTISDFHLL

SEQ ID NO: 7760 - protein, 11 aa, Homo sapiens
FLDVLFPLVVD

SEQ ID NO: 7761 - protein, 9 aa, Homo sapiens
FLDVRNIIL

SEQ ID NO: 7762 - protein, 9 aa, Homo sapiens
FLDYGENLV

SEQ ID NO: 7763 - protein, 9 aa, Homo sapiens
FLEANVPHA

SEQ ID NO: 7764 - protein, 11 aa, Homo sapiens
FLEDDDKLEQI

SEQ ID NO: 7765 - protein, 10 aa, Homo sapiens
FLEDDDVAAV

SEQ ID NO: 7766 - protein, 10 aa, Homo sapiens
FLEEDFIPFA

SEQ ID NO: 7767 - protein, 9 aa, Homo sapiens
FLEEEVYPL

SEQ ID NO: 7768 - protein, 9 aa, Homo sapiens
FLEEFITPI

SEQ ID NO: 7769 - protein, 12 aa, Homo sapiens
FLEEFITPIVKA

SEQ ID NO: 7770 - protein, 12 aa, Homo sapiens
FLEEFITPIVKV

SEQ ID NO: 7771 - protein, 12 aa, Homo sapiens
FLEEKIPSISDL

SEQ ID NO: 7772 - protein, 9 aa, Homo sapiens
FLEENSFSV

SEQ ID NO: 7773 - protein, 9 aa, Homo sapiens
FLEEREIAL

SEQ ID NO: 7774 - protein, 11 aa, Homo sapiens
FLEEVKVSREM

SEQ ID NO: 7775 - protein, 11 aa, Homo sapiens
FLEFAEDVIQV

SEQ ID NO: 7776 - protein, 9 aa, Homo sapiens
FLEPDSWET

SEQ ID NO: 7777 - protein, 9 aa, Homo sapiens
FLEQQMHPT

SEQ ID NO: 7778 - protein, 11 aa, Homo sapiens
FLEQQNKILLA

SEQ ID NO: 7779 - protein, 9 aa, Homo sapiens
FLEQQNKLL

SEQ ID NO: 7780 - protein, 9 aa, Homo sapiens
FLETESTFM

SEQ ID NO: 7781 - protein, 9 aa, Homo sapiens
FLETVELQI

SEQ ID NO: 7782 - protein, 11 aa, Homo sapiens
FLETVELQISL

SEQ ID NO: 7783 - protein, 8 aa, Homo sapiens
FLFDEEME

SEQ ID NO: 7784 - protein, 9 aa, Homo sapiens
FLFDEEMEQ

SEQ ID NO: 7785 - protein, 11 aa, Homo sapiens
FLFDEEMEQMD

SEQ ID NO: 7786 - protein, 12 aa, Homo sapiens
FLFDEEMEQMDG

SEQ ID NO: 7787 - protein, 12 aa, Homo sapiens
FLFDGSPTYVLA

SEQ ID NO: 7788 - protein, 11 aa, Homo sapiens
FLFDIPKILDL

SEQ ID NO: 7789 - protein, 8 aa, Homo sapiens
FLFDKPVS

SEQ ID NO: 7790 - protein, 10 aa, Homo sapiens
FLFDKPVSPL

SEQ ID NO: 7791 - protein, 11 aa, Homo sapiens
FLFDKPVSPLL

SEQ ID NO: 7792 - protein, 12 aa, Homo sapiens
FLFDKPVSPLLL

SEQ ID NO: 7793 - protein, 10 aa, Homo sapiens
FLFDMATGKL

SEQ ID NO: 7794 - protein, 11 aa, Homo sapiens
FLFDMATGKLT

SEQ ID NO: 7795 - protein, 9 aa, Homo sapiens
FLFDTKPLI

SEQ ID NO: 7796 - protein, 12 aa, Homo sapiens
FLFDTKPLIVQY

SEQ ID NO: 7797 - protein, 9 aa, Homo sapiens
FLFDVVSKI

SEQ ID NO: 7798 - protein, 9 aa, Homo sapiens
FLFENQTPA

SEQ ID NO: 7799 - protein, 11 aa, Homo sapiens
FLFENQTPAHV

SEQ ID NO: 7800 - protein, 11 aa, Homo sapiens
FLFEPVVKAFL

SEQ ID NO: 7801 - protein, 9 aa, Homo sapiens
FLFGGVLMT

SEQ ID NO: 7802 - protein, 9 aa, Homo sapiens
FLFGSPLGL

SEQ ID NO: 7803 - protein, 10 aa, Homo sapiens
FLFNTENKLL

SEQ ID NO: 7804 - protein, 11 aa, Homo sapiens
FLFPELRIIST

SEQ ID NO: 7805 - protein, 11 aa, Homo sapiens
FLFPGTENQEL

SEQ ID NO: 7806 - protein, 9 aa, Homo sapiens
FLFRDGDIL

SEQ ID NO: 7807 - protein, 11 aa, Homo sapiens
FLFSSDHLIEM

SEQ ID NO: 7808 - protein, 12 aa, Homo sapiens
FLFVDADQIVRT

SEQ ID NO: 7809 - protein, 11 aa, Homo sapiens
FLGADVTHPPA

SEQ ID NO: 7810 - protein, 8 aa, Homo sapiens
FLGAVEEA

SEQ ID NO: 7811 - protein, 11 aa, Homo sapiens
FLGDDVFLREL

SEQ ID NO: 7812 - protein, 11 aa, Homo sapiens
FLGDEETVRKA

SEQ ID NO: 7813 - protein, 10 aa, Homo sapiens
FLGDGLGVPT

SEQ ID NO: 7814 - protein, 11 aa, Homo sapiens
FLGDGLGVPTV

SEQ ID NO: 7815 - protein, 8 aa, Homo sapiens
FLGDGMGV

SEQ ID NO: 7816 - protein, 10 aa, Homo sapiens
FLGDGMGVST

SEQ ID NO: 7817 - protein, 11 aa, Homo sapiens
FLGDGMGVSTV

SEQ ID NO: 7818 - protein, 11 aa, Homo sapiens
FLGDTDVFGAA

SEQ ID NO: 7819 - protein, 12 aa, Homo sapiens
FLGDTDVFGAAS

SEQ ID NO: 7820 - protein, 10 aa, Homo sapiens
FLGEIEELRL

SEQ ID NO: 7821 - protein, 12 aa, Homo sapiens
FLGEMPAEPMTI

SEQ ID NO: 7822 - protein, 9 aa, Homo sapiens
FLGFFMVPA

SEQ ID NO: 7823 - protein, 9 aa, Homo sapiens
FLGGDMEHT

SEQ ID NO: 7824 - protein, 12 aa, Homo sapiens
FLGGDMEHTHLV

SEQ ID NO: 7825 - protein, 11 aa, Homo sapiens
FLGGEDFDQAL

SEQ ID NO: 7826 - protein, 12 aa, Homo sapiens
FLGGEDFDQALL

SEQ ID NO: 7827 - protein, 9 aa, Homo sapiens
FLGKVVNPT

SEQ ID NO: 7828 - protein, 9 aa, Homo sapiens
FLGPEDLRV

SEQ ID NO: 7829 - protein, 9 aa, Homo sapiens
FLGPEPKSV

SEQ ID NO: 7830 - protein, 8 aa, Homo sapiens
FLGPIIKA

SEQ ID NO: 7831 - protein, 11 aa, Homo sapiens
FLGPPPPPLLL

SEQ ID NO: 7832 - protein, 12 aa, Homo sapiens
FLGPPPPPLLLL

SEQ ID NO: 7833 - protein, 9 aa, Homo sapiens
FLGQKLQVV

SEQ ID NO: 7834 - protein, 10 aa, Homo sapiens
FLGSLSLLPA

SEQ ID NO: 7835 - protein, 8 aa, Homo sapiens
FLGTTPTL

SEQ ID NO: 7836 - protein, 8 aa, Homo sapiens
FLGVAEQL

SEQ ID NO: 7837 - protein, 9 aa, Homo sapiens
FLHEATARL

SEQ ID NO: 7838 - protein, 10 aa, Homo sapiens
FLHELNVPFF

SEQ ID NO: 7839 - protein, 12 aa, Homo sapiens
FLHELNVPFFKV

SEQ ID NO: 7840 - protein, 10 aa, Homo sapiens
FLHNNRITHL

SEQ ID NO: 7841 - protein, 10 aa, Homo sapiens
FLHPEEFEHM

SEQ ID NO: 7842 - protein, 10 aa, Homo sapiens
FLHPEEFPHM

SEQ ID NO: 7843 - protein, 10 aa, Homo sapiens
FLIAEYFEHV

SEQ ID NO: 7844 - protein, 10 aa, Homo sapiens
FLIAQLPKLQ

SEQ ID NO: 7845 - protein, 9 aa, Homo sapiens
FLIEPFVPH

SEQ ID NO: 7846 - protein, 10 aa, Homo sapiens
FLIEPFVPHS

SEQ ID NO: 7847 - protein, 11 aa, Homo sapiens
FLIEPFVPHSQ

SEQ ID NO: 7848 - protein, 12 aa, Homo sapiens
FLIEPFVPHSQA

SEQ ID NO: 7849 - protein, 11 aa, Homo sapiens
FLIGDEAATHL

SEQ ID NO: 7850 - protein, 9 aa, Homo sapiens
FLIPVLNGL

SEQ ID NO: 7851 - protein, 11 aa, Homo sapiens
FLIPVQTQHPI

SEQ ID NO: 7852 - protein, 10 aa, Homo sapiens
FLITHNPTNA

SEQ ID NO: 7853 - protein, 9 aa, Homo sapiens
FLKALQEKV

SEQ ID NO: 7854 - protein, 10 aa, Homo sapiens
FLKDCVGPEV

SEQ ID NO: 7855 - protein, 9 aa, Homo sapiens
FLKELVEPV

SEQ ID NO: 7856 - protein, 9 aa, Homo sapiens
FLKEPILNI

SEQ ID NO: 7857 - protein, 11 aa, Homo sapiens
FLKPSTSGDSL

SEQ ID NO: 7858 - protein, 9 aa, Homo sapiens
FLKQVSNMV

SEQ ID NO: 7859 - protein, 10 aa, Homo sapiens
FLKTLEDPDL

SEQ ID NO: 7860 - protein, 10 aa, Homo sapiens
FLKVLNNMEI

SEQ ID NO: 7861 - protein, 9 aa, Homo sapiens
FLLAEDTKV

SEQ ID NO: 7862 - protein, 9 aa, Homo sapiens
FLLAKVINA

SEQ ID NO: 7863 - protein, 10 aa, Homo sapiens
FLLDADMQSL

SEQ ID NO: 7864 - protein, 11 aa, Homo sapiens
FLLDAYKQVKL

SEQ ID NO: 7865 - protein, 9 aa, Homo sapiens
FLLDEISLA

SEQ ID NO: 7866 - protein, 9 aa, Homo sapiens
FLLDEQTSL

SEQ ID NO: 7867 - protein, 10 aa, Homo sapiens
FLLDESLESL

SEQ ID NO: 7868 - protein, 9 aa, Homo sapiens
FLLDGFPRT

SEQ ID NO: 7869 - protein, 10 aa, Homo sapiens
FLLDGLHEDL

SEQ ID NO: 7870 - protein, 10 aa, Homo sapiens
FLLDISETDL

SEQ ID NO: 7871 - protein, 12 aa, Homo sapiens
FLLDISETDLSS

SEQ ID NO: 7872 - protein, 12 aa, Homo sapiens
FLLDKKIGVNQP

SEQ ID NO: 7873 - protein, 12 aa, Homo sapiens
FLLEIKETTESL

SEQ ID NO: 7874 - protein, 11 aa, Homo sapiens
FLLEQPEIQVA

SEQ ID NO: 7875 - protein, 10 aa, Homo sapiens
FLLETDNPRT

SEQ ID NO: 7876 - protein, 12 aa, Homo sapiens
FLLETDNPRTTL

SEQ ID NO: 7877 - protein, 11 aa, Homo sapiens
FLLFEGEKITI

SEQ ID NO: 7878 - protein, 8 aa, Homo sapiens
FLLGFQFI

SEQ ID NO: 7879 - protein, 10 aa, Homo sapiens
FLLGLLTNEL

SEQ ID NO: 7880 - protein, 11 aa, Homo sapiens
FLLGPEALSFA

SEQ ID NO: 7881 - protein, 12 aa, Homo sapiens
FLLKDSETSQRL

SEQ ID NO: 7882 - protein, 9 aa, Homo sapiens
FLLNYPFST

SEQ ID NO: 7883 - protein, 10 aa, Homo sapiens
FLLNYPFSTS

SEQ ID NO: 7884 - protein, 11 aa, Homo sapiens
FLLNYPFSTSV

SEQ ID NO: 7885 - protein, 11 aa, Homo sapiens
FLLPHPGLQVA

SEQ ID NO: 7886 - protein, 12 aa, Homo sapiens
FLLPILSQIYSD

SEQ ID NO: 7887 - protein, 9 aa, Homo sapiens
FLLPKFHGV

SEQ ID NO: 7888 - protein, 10 aa, Homo sapiens
FLLPPPLPSL

SEQ ID NO: 7889 - protein, 9 aa, Homo sapiens
FLLSKGLQV

SEQ ID NO: 7890 - protein, 10 aa, Homo sapiens
FLLTTTPRPV

SEQ ID NO: 7891 - protein, 10 aa, Homo sapiens
FLLVGTQIDL

SEQ ID NO: 7892 - protein, 11 aa, Homo sapiens
FLMANGQLVKM

SEQ ID NO: 7893 - protein, 10 aa, Homo sapiens
FLMDAIQTNF

SEQ ID NO: 7894 - protein, 11 aa, Homo sapiens
FLMECRNSPVT

SEQ ID NO: 7895 - protein, 9 aa, Homo sapiens
FLMKKELNY

SEQ ID NO: 7896 - protein, 10 aa, Homo sapiens
FLMKKELNYF

SEQ ID NO: 7897 - protein, 11 aa, Homo sapiens
FLMKKELNYFA

SEQ ID NO: 7898 - protein, 9 aa, Homo sapiens
FLMKLSHET

SEQ ID NO: 7899 - protein, 10 aa, Homo sapiens
FLMKLSHETV

SEQ ID NO: 7900 - protein, 10 aa, Homo sapiens
FLMPFPVNYV

SEQ ID NO: 7901 - protein, 10 aa, Homo sapiens
FLMSDKPLHL

SEQ ID NO: 7902 - protein, 9 aa, Homo sapiens
FLMSLVNQV

SEQ ID NO: 7903 - protein, 9 aa, Homo sapiens
FLMTGYTPL

SEQ ID NO: 7904 - protein, 11 aa, Homo sapiens
FLNDTTKPVGL

SEQ ID NO: 7905 - protein, 10 aa, Homo sapiens
FLNEDLEVKI

SEQ ID NO: 7906 - protein, 11 aa, Homo sapiens
FLNEHPGGEEV

SEQ ID NO: 7907 - protein, 12 aa, Homo sapiens
FLNEHPGGEEVL

SEQ ID NO: 7908 - protein, 9 aa, Homo sapiens
FLNELIKVV

SEQ ID NO: 7909 - protein, 10 aa, Homo sapiens
FLNENLPESI

SEQ ID NO: 7910 - protein, 9 aa, Homo sapiens
FLNEVLVKL

SEQ ID NO: 7911 - protein, 11 aa, Homo sapiens
FLNGGILNYMI

SEQ ID NO: 7912 - protein, 9 aa, Homo sapiens
FLNGKSIGL

SEQ ID NO: 7913 - protein, 9 aa, Homo sapiens
FLNGKSVGV

SEQ ID NO: 7914 - protein, 10 aa, Homo sapiens
FLNGLTGKPV

SEQ ID NO: 7915 - protein, 12 aa, Homo sapiens
FLNGLTGKPVMV

SEQ ID NO: 7916 - protein, 10 aa, Homo sapiens
FLNKQAPQTI

SEQ ID NO: 7917 - protein, 10 aa, Homo sapiens
FLNPNDPYHA

SEQ ID NO: 7918 - protein, 10 aa, Homo sapiens
FLNQFVVHTV

SEQ ID NO: 7919 - protein, 9 aa, Homo sapiens
FLNYFDKIL

SEQ ID NO: 7920 - protein, 8 aa, Homo sapiens
FLPEAFDF

SEQ ID NO: 7921 - protein, 9 aa, Homo sapiens
FLPEAFDFI

SEQ ID NO: 7922 - protein, 10 aa, Homo sapiens
FLPEAPAELL

SEQ ID NO: 7923 - protein, 9 aa, Homo sapiens
FLPEEYPMA

SEQ ID NO: 7924 - protein, 11 aa, Homo sapiens
FLPEGSKLVPV

SEQ ID NO: 7925 - protein, 12 aa, Homo sapiens
FLPEGSKLVPVA

SEQ ID NO: 7926 - protein, 9 aa, Homo sapiens
FLPEMLSKV

SEQ ID NO: 7927 - protein, 9 aa, Homo sapiens
FLPFPFEQL

SEQ ID NO: 7928 - protein, 9 aa, Homo sapiens
FLPHFQHFA

SEQ ID NO: 7929 - protein, 9 aa, Homo sapiens
FLPITPHYV

SEQ ID NO: 7930 - protein, 9 aa, Homo sapiens
FLPITPQFV

SEQ ID NO: 7931 - protein, 9 aa, Homo sapiens
FLPKDVALA

SEQ ID NO: 7932 - protein, 9 aa, Homo sapiens
FLPLFDRVL

SEQ ID NO: 7933 - protein, 10 aa, Homo sapiens
FLPLFDRVLV

SEQ ID NO: 7934 - protein, 11 aa, Homo sapiens
FLPPAAPGGEV

SEQ ID NO: 7935 - protein, 9 aa, Homo sapiens
FLPPPPPPL

SEQ ID NO: 7936 - protein, 12 aa, Homo sapiens
FLPPPPPPLDDS

SEQ ID NO: 7937 - protein, 10 aa, Homo sapiens
FLPRQPPMSL

SEQ ID NO: 7938 - protein, 9 aa, Homo sapiens
FLPSFLSYI

SEQ ID NO: 7939 - protein, 9 aa, Homo sapiens
FLPSPSPPA

SEQ ID NO: 7940 - protein, 9 aa, Homo sapiens
FLQARTPTL

SEQ ID NO: 7941 - protein, 10 aa, Homo sapiens
FLQARTPTLA

SEQ ID NO: 7942 - protein, 10 aa, Homo sapiens
FLQDGEVQFL

SEQ ID NO: 7943 - protein, 9 aa, Homo sapiens
FLQDGTKTV

SEQ ID NO: 7944 - protein, 12 aa, Homo sapiens
FLQDTIEEMALK

SEQ ID NO: 7945 - protein, 9 aa, Homo sapiens
FLQEEAEKM

SEQ ID NO: 7946 - protein, 11 aa, Homo sapiens
FLQEETVSQQI

SEQ ID NO: 7947 - protein, 9 aa, Homo sapiens
FLQEFSQQT

SEQ ID NO: 7948 - protein, 12 aa, Homo sapiens
FLQEHGSDSFLA

SEQ ID NO: 7949 - protein, 9 aa, Homo sapiens
FLQEKGPSV

SEQ ID NO: 7950 - protein, 11 aa, Homo sapiens
FLQEKSPAVAT

SEQ ID NO: 7951 - protein, 10 aa, Homo sapiens
FLQELQLEHA

SEQ ID NO: 7952 - protein, 9 aa, Homo sapiens
FLQENDQSL

SEQ ID NO: 7953 - protein, 12 aa, Homo sapiens
FLQENDQSLLNF

SEQ ID NO: 7954 - protein, 10 aa, Homo sapiens
FLQEQLVELK

SEQ ID NO: 7955 - protein, 10 aa, Homo sapiens
FLQEYVANLL

SEQ ID NO: 7956 - protein, 10 aa, Homo sapiens
FLQKAPVPST

SEQ ID NO: 7957 - protein, 9 aa, Homo sapiens
FLQLDVKRV

SEQ ID NO: 7958 - protein, 12 aa, Homo sapiens
FLQLFEGDDHKV

SEQ ID NO: 7959 - protein, 9 aa, Homo sapiens
FLQPDLDSL

SEQ ID NO: 7960 - protein, 9 aa, Homo sapiens
FLQPGGYHV

SEQ ID NO: 7961 - protein, 12 aa, Homo sapiens
FLQPVGLGNVTL

SEQ ID NO: 7962 - protein, 12 aa, Homo sapiens
FLQPVHKIDMNL

SEQ ID NO: 7963 - protein, 9 aa, Homo sapiens
FLQRFIDPL

SEQ ID NO: 7964 - protein, 10 aa, Homo sapiens
FLQSVQVPEF

SEQ ID NO: 7965 - protein, 9 aa, Homo sapiens
FLQTVINKV

SEQ ID NO: 7966 - protein, 9 aa, Homo sapiens
FLRASEEHL

SEQ ID NO: 7967 - protein, 10 aa, Homo sapiens
FLRDYTQINV

SEQ ID NO: 7968 - protein, 9 aa, Homo sapiens
FLRELISNA

SEQ ID NO: 7969 - protein, 12 aa, Homo sapiens
FLRELISNSSDA

SEQ ID NO: 7970 - protein, 11 aa, Homo sapiens
FLREPDSDTEL

SEQ ID NO: 7971 - protein, 11 aa, Homo sapiens
FLSCPIPKLLL

SEQ ID NO: 7972 - protein, 10 aa, Homo sapiens
FLSDAIPGLK

SEQ ID NO: 7973 - protein, 8 aa, Homo sapiens
FLSDFEMM

SEQ ID NO: 7974 - protein, 9 aa, Homo sapiens
FLSDFEMML

SEQ ID NO: 7975 - protein, 10 aa, Homo sapiens
FLSDPQVHTV

SEQ ID NO: 7976 - protein, 12 aa, Homo sapiens
FLSDPQVHTVLV

SEQ ID NO: 7977 - protein, 10 aa, Homo sapiens
FLSEEDADYA

SEQ ID NO: 7978 - protein, 11 aa, Homo sapiens
FLSEEDADYAI

SEQ ID NO: 7979 - protein, 9 aa, Homo sapiens
FLSEEDRGL

SEQ ID NO: 7980 - protein, 11 aa, Homo sapiens
FLSEEEKDLIL

SEQ ID NO: 7981 - protein, 9 aa, Homo sapiens
FLSEETEAS

SEQ ID NO: 7982 - protein, 10 aa, Homo sapiens
FLSEETEASL

SEQ ID NO: 7983 - protein, 11 aa, Homo sapiens
FLSEETEASLA

SEQ ID NO: 7984 - protein, 12 aa, Homo sapiens
FLSEETEASLAS

SEQ ID NO: 7985 - protein, 9 aa, Homo sapiens
FLSEKDSLL

SEQ ID NO: 7986 - protein, 8 aa, Homo sapiens
FLSELTQQ

SEQ ID NO: 7987 - protein, 11 aa, Homo sapiens
FLSELTQQLAQ

SEQ ID NO: 7988 - protein, 9 aa, Homo sapiens
FLSFPTTKT

SEQ ID NO: 7989 - protein, 8 aa, Homo sapiens
FLSGFQVV

SEQ ID NO: 7990 - protein, 9 aa, Homo sapiens
FLSGFQVVV

SEQ ID NO: 7991 - protein, 10 aa, Homo sapiens
FLSGFQVVVL

SEQ ID NO: 7992 - protein, 8 aa, Homo sapiens
FLSGVNIQ

SEQ ID NO: 7993 - protein, 9 aa, Homo sapiens
FLSGVNIQI

SEQ ID NO: 7994 - protein, 10 aa, Homo sapiens
FLSGVNIQIV

SEQ ID NO: 7995 - protein, 11 aa, Homo sapiens
FLSGVNIQIVG

SEQ ID NO: 7996 - protein, 12 aa, Homo sapiens
FLSGVNIQIVGD

SEQ ID NO: 7997 - protein, 11 aa, Homo sapiens
FLSHVVSQHQA

SEQ ID NO: 7998 - protein, 9 aa, Homo sapiens
FLSISSPKV

SEQ ID NO: 7999 - protein, 9 aa, Homo sapiens
FLSLINVGL

SEQ ID NO: 8000 - protein, 10 aa, Homo sapiens
FLSLINVGLI

SEQ ID NO: 8001 - protein, 11 aa, Homo sapiens
FLSLINVGLIS

SEQ ID NO: 8002 - protein, 12 aa, Homo sapiens
FLSLINVGLISV

SEQ ID NO: 8003 - protein, 11 aa, Homo sapiens
FLSPQQPPLLL

SEQ ID NO: 8004 - protein, 10 aa, Homo sapiens
FLSQGQVLKL

SEQ ID NO: 8005 - protein, 9 aa, Homo sapiens
FLSSLTETI

SEQ ID NO: 8006 - protein, 8 aa, Homo sapiens
FLSTINVG

SEQ ID NO: 8007 - protein, 10 aa, Homo sapiens
FLSTINVGLT

SEQ ID NO: 8008 - protein, 11 aa, Homo sapiens
FLSTINVGLTS

SEQ ID NO: 8009 - protein, 12 aa, Homo sapiens
FLSTINVGLTSI

SEQ ID NO: 8010 - protein, 11 aa, Homo sapiens
FLSTSIAQLKV

SEQ ID NO: 8011 - protein, 9 aa, Homo sapiens
FLTDLFAQL

SEQ ID NO: 8012 - protein, 12 aa, Homo sapiens
FLTDSNNIKEVL

SEQ ID NO: 8013 - protein, 11 aa, Homo sapiens
FLTDTAKQIKT

SEQ ID NO: 8014 - protein, 8 aa, Homo sapiens
FLTEFINY

SEQ ID NO: 8015 - protein, 9 aa, Homo sapiens
FLTEFINYI

SEQ ID NO: 8016 - protein, 10 aa, Homo sapiens
FLTEIEVLDV

SEQ ID NO: 8017 - protein, 8 aa, Homo sapiens
FLTELVIS

SEQ ID NO: 8018 - protein, 9 aa, Homo sapiens
FLTELVISL

SEQ ID NO: 8019 - protein, 12 aa, Homo sapiens
FLTELVISLEKL

SEQ ID NO: 8020 - protein, 11 aa, Homo sapiens
FLTFDDLLNRL

SEQ ID NO: 8021 - protein, 9 aa, Homo sapiens
FLVADKVIV

SEQ ID NO: 8022 - protein, 10 aa, Homo sapiens
FLVADKVIVT

SEQ ID NO: 8023 - protein, 11 aa, Homo sapiens
FLVADKVIVTS

SEQ ID NO: 8024 - protein, 9 aa, Homo sapiens
FLVDDSSSV

SEQ ID NO: 8025 - protein, 11 aa, Homo sapiens
FLVDFGKEPLG

SEQ ID NO: 8026 - protein, 11 aa, Homo sapiens
FLVDPVRNQRL

SEQ ID NO: 8027 - protein, 9 aa, Homo sapiens
FLVELSRVL

SEQ ID NO: 8028 - protein, 10 aa, Homo sapiens
FLVELSRVLA

SEQ ID NO: 8029 - protein, 9 aa, Homo sapiens
FLVGERVTL

SEQ ID NO: 8030 - protein, 11 aa, Homo sapiens
FLVHPIEGSTT

SEQ ID NO: 8031 - protein, 11 aa, Homo sapiens
FLVNPESGYNV

SEQ ID NO: 8032 - protein, 9 aa, Homo sapiens
FLVSQLIRA

SEQ ID NO: 8033 - protein, 11 aa, Homo sapiens
FLVTEVENGGS

SEQ ID NO: 8034 - protein, 12 aa, Homo sapiens
FLVTEVENGGSL

SEQ ID NO: 8035 - protein, 11 aa, Homo sapiens
FLWDEGFHQLV

SEQ ID NO: 8036 - protein, 12 aa, Homo sapiens
FLWDEGFHQLVV

SEQ ID NO: 8037 - protein, 12 aa, Homo sapiens
FLWDLGSGSTRL

SEQ ID NO: 8038 - protein, 11 aa, Homo sapiens
FLWDPAKRTSV

SEQ ID NO: 8039 - protein, 12 aa, Homo sapiens
FLWDVNTLTALT

SEQ ID NO: 8040 - protein, 10 aa, Homo sapiens
FLWDVPSNWT

SEQ ID NO: 8041 - protein, 12 aa, Homo sapiens
FLWDVPSNWTLE

SEQ ID NO: 8042 - protein, 10 aa, Homo sapiens
FLWEVGEAEA

SEQ ID NO: 8043 - protein, 11 aa, Homo sapiens
FLWEYGDLHLF

SEQ ID NO: 8044 - protein, 10 aa, Homo sapiens
FLWPGFGENA

SEQ ID NO: 8045 - protein, 10 aa, Homo sapiens
FLYDLVMTHA

SEQ ID NO: 8046 - protein, 11 aa, Homo sapiens
FLYDLVMTHAL

SEQ ID NO: 8047 - protein, 12 aa, Homo sapiens
FLYDLVMTHALE

SEQ ID NO: 8048 - protein, 12 aa, Homo sapiens
FLYDLVMTHALQ

SEQ ID NO: 8049 - protein, 9 aa, Homo sapiens
FLYEADVQV

SEQ ID NO: 8050 - protein, 12 aa, Homo sapiens
FLYGDHDGEVYA

SEQ ID NO: 8051 - protein, 11 aa, Homo sapiens
FLYPLVGTMST

SEQ ID NO: 8052 - protein, 11 aa, Homo sapiens
FLYSDREIEVM

SEQ ID NO: 8053 - protein, 8 aa, Homo sapiens
FMANIPLL

SEQ ID NO: 8054 - protein, 9 aa, Homo sapiens
FMANIPLLL

SEQ ID NO: 8055 - protein, 11 aa, Homo sapiens
FMANIPLLLYP

SEQ ID NO: 8056 - protein, 12 aa, Homo sapiens
FMANIPLLLYPQ

SEQ ID NO: 8057 - protein, 11 aa, Homo sapiens
FMATNDLMTEL

SEQ ID NO: 8058 - protein, 8 aa, Homo sapiens
FMATVTKA

SEQ ID NO: 8059 - protein, 9 aa, Homo sapiens
FMDDFFHQV

SEQ ID NO: 8060 - protein, 9 aa, Homo sapiens
FMDKLGENL

SEQ ID NO: 8061 - protein, 11 aa, Homo sapiens
FMDKLGENLKI

SEQ ID NO: 8062 - protein, 10 aa, Homo sapiens
FMEAIAPPLL

SEQ ID NO: 8063 - protein, 9 aa, Homo sapiens
FMEDMMPKV

SEQ ID NO: 8064 - protein, 12 aa, Homo sapiens
FMEEIDKEISEM

SEQ ID NO: 8065 - protein, 9 aa, Homo sapiens
FMILPVGAA

SEQ ID NO: 8066 - protein, 11 aa, Homo sapiens
FMILPVGAANF

SEQ ID NO: 8067 - protein, 11 aa, Homo sapiens
FMLATQLNPLV

SEQ ID NO: 8068 - protein, 10 aa, Homo sapiens
FMMEVKDPNM

SEQ ID NO: 8069 - protein, 10 aa, Homo sapiens
FMNPFNMPNL

SEQ ID NO: 8070 - protein, 11 aa, Homo sapiens
FMQGEIATILA

SEQ ID NO: 8071 - protein, 11 aa, Homo sapiens
FMVPSEAISLS

SEQ ID NO: 8072 - protein, 9 aa, Homo sapiens
FMVTRSYTV

SEQ ID NO: 8073 - protein, 9 aa, Homo sapiens
FMWDVAEEL

SEQ ID NO: 8074 - protein, 11 aa, Homo sapiens
FMWDVAEELKA

SEQ ID NO: 8075 - protein, 12 aa, Homo sapiens
FMWNPHLGYILT

SEQ ID NO: 8076 - protein, 10 aa, Homo sapiens
FNFGKEKFEV

SEQ ID NO: 8077 - protein, 11 aa, Homo sapiens
FQAHKEAIREA

SEQ ID NO: 8078 - protein, 11 aa, Homo sapiens
FQDEEEENEEV

SEQ ID NO: 8079 - protein, 10 aa, Homo sapiens
FQKENGTVTA

SEQ ID NO: 8080 - protein, 9 aa, Homo sapiens
FQQKQIENV

SEQ ID NO: 8081 - protein, 9 aa, Homo sapiens
FQVGSMPPA

SEQ ID NO: 8082 - protein, 9 aa, Homo sapiens
FQYDHEAFL

SEQ ID NO: 8083 - protein, 10 aa, Homo sapiens
FQYTDEHGEV

SEQ ID NO: 8084 - protein, 11 aa, Homo sapiens
FSHEEIAMATV

SEQ ID NO: 8085 - protein, 11 aa, Homo sapiens
FSSEVTAALRV

SEQ ID NO: 8086 - protein, 9 aa, Homo sapiens
FTASAGIQV

SEQ ID NO: 8087 - protein, 10 aa, Homo sapiens
FTASAGIQVV

SEQ ID NO: 8088 - protein, 11 aa, Homo sapiens
FTLDDVIQTGV

SEQ ID NO: 8089 - protein, 12 aa, Homo sapiens
FTYEGNSNDIRV

SEQ ID NO: 8090 - protein, 9 aa, Homo sapiens
FVAAAPVAA

SEQ ID NO: 8091 - protein, 11 aa, Homo sapiens
FVAELKGLDPA

SEQ ID NO: 8092 - protein, 9 aa, Homo sapiens
FVAESAEVL

SEQ ID NO: 8093 - protein, 9 aa, Homo sapiens
FVAPQPVVV

SEQ ID NO: 8094 - protein, 9 aa, Homo sapiens
FVAQFKFTV

SEQ ID NO: 8095 - protein, 9 aa, Homo sapiens
FVDPNKQNL

SEQ ID NO: 8096 - protein, 10 aa, Homo sapiens
FVDPNKQNLI

SEQ ID NO: 8097 - protein, 10 aa, Homo sapiens
FVDPNTQEKV

SEQ ID NO: 8098 - protein, 9 aa, Homo sapiens
FVDPWTVQT

SEQ ID NO: 8099 - protein, 11 aa, Homo sapiens
FVDRPVIGSSV

SEQ ID NO: 8100 - protein, 10 aa, Homo sapiens
FVDVSSVPLA

SEQ ID NO: 8101 - protein, 11 aa, Homo sapiens
FVDVSSVPLAI

SEQ ID NO: 8102 - protein, 9 aa, Homo sapiens
FVDYQTTMV

SEQ ID NO: 8103 - protein, 9 aa, Homo sapiens
FVEEFIWPA

SEQ ID NO: 8104 - protein, 10 aa, Homo sapiens
FVFDRPLPVS

SEQ ID NO: 8105 - protein, 11 aa, Homo sapiens
FVGSPPKGLSI

SEQ ID NO: 8106 - protein, 9 aa, Homo sapiens
FVGYFPATV

SEQ ID NO: 8107 - protein, 9 aa, Homo sapiens
FVIEAGALM

SEQ ID NO: 8108 - protein, 10 aa, Homo sapiens
FVIEEVPGEL

SEQ ID NO: 8109 - protein, 11 aa, Homo sapiens
FVIEEVPGELM

SEQ ID NO: 8110 - protein, 9 aa, Homo sapiens
FVKDGMDTV

SEQ ID NO: 8111 - protein, 10 aa, Homo sapiens
FVLDEADEML

SEQ ID NO: 8112 - protein, 11 aa, Homo sapiens
FVLDYINGGEL

SEQ ID NO: 8113 - protein, 9 aa, Homo sapiens
FVNITPAEV

SEQ ID NO: 8114 - protein, 9 aa, Homo sapiens
FVPKFSISA

SEQ ID NO: 8115 - protein, 10 aa, Homo sapiens
FVQNSQPVAV

SEQ ID NO: 8116 - protein, 11 aa, Homo sapiens
FVQSEIFPLET

SEQ ID NO: 8117 - protein, 11 aa, Homo sapiens
FVVDVAQGTQV

SEQ ID NO: 8118 - protein, 10 aa, Homo sapiens
FVVEAIGDDV

SEQ ID NO: 8119 - protein, 10 aa, Homo sapiens
FVVESIGSEV

SEQ ID NO: 8120 - protein, 11 aa, Homo sapiens
FVVGFISGSRV

SEQ ID NO: 8121 - protein, 12 aa, Homo sapiens
FVWEPAMVRINA

SEQ ID NO: 8122 - protein, 10 aa, Homo sapiens
FVYGGPQVQL

SEQ ID NO: 8123 - protein, 10 aa, Homo sapiens
GAAGGEIPAV

SEQ ID NO: 8124 - protein, 9 aa, Homo sapiens
GGFEITPPV

SEQ ID NO: 8125 - protein, 9 aa, Homo sapiens
GIALNDHFV

SEQ ID NO: 8126 - protein, 9 aa, Homo sapiens
GIFEVKATA

SEQ ID NO: 8127 - protein, 9 aa, Homo sapiens
GIIDPGSTV

SEQ ID NO: 8128 - protein, 11 aa, Homo sapiens
GIIDPGSTVTV

SEQ ID NO: 8129 - protein, 9 aa, Homo sapiens
GIIGGLTSV

SEQ ID NO: 8130 - protein, 10 aa, Homo sapiens
GIKDDVFLSV

SEQ ID NO: 8131 - protein, 11 aa, Homo sapiens
GILDTETLEKV

SEQ ID NO: 8132 - protein, 10 aa, Homo sapiens
GILGYTEHQV

SEQ ID NO: 8133 - protein, 11 aa, Homo sapiens
GILGYTEHQVV

SEQ ID NO: 8134 - protein, 12 aa, Homo sapiens
GIMDAANFEQFL

SEQ ID NO: 8135 - protein, 9 aa, Homo sapiens
GIMVELPQL

SEQ ID NO: 8136 - protein, 11 aa, Homo sapiens
GIQVVGDDLTV

SEQ ID NO: 8137 - protein, 10 aa, Homo sapiens
GISEETTTGV

SEQ ID NO: 8138 - protein, 9 aa, Homo sapiens
GIVEGLMTT

SEQ ID NO: 8139 - protein, 11 aa, Homo sapiens
GLAAAIAGAKL

SEQ ID NO: 8140 - protein, 9 aa, Homo sapiens
GLAAGPPEA

SEQ ID NO: 8141 - protein, 9 aa, Homo sapiens
GLAAISLYL

SEQ ID NO: 8142 - protein, 10 aa, Homo sapiens
GLAALAKVLL

SEQ ID NO: 8143 - protein, 9 aa, Homo sapiens
GLAATLYSL

SEQ ID NO: 8144 - protein, 12 aa, Homo sapiens
GLAATVTITHLL

SEQ ID NO: 8145 - protein, 9 aa, Homo sapiens
GLADNTVIA

SEQ ID NO: 8146 - protein, 9 aa, Homo sapiens
GLAEALGTL

SEQ ID NO: 8147 - protein, 11 aa, Homo sapiens
GLAEAPEHGTT

SEQ ID NO: 8148 - protein, 12 aa, Homo sapiens
GLAEAPEHGTTA

SEQ ID NO: 8149 - protein, 10 aa, Homo sapiens
GLAEDIENEV

SEQ ID NO: 8150 - protein, 11 aa, Homo sapiens
GLAEDIENEVV

SEQ ID NO: 8151 - protein, 11 aa, Homo sapiens
GLAEEDLETLL

SEQ ID NO: 8152 - protein, 10 aa, Homo sapiens
GLAEHLSPLM

SEQ ID NO: 8153 - protein, 11 aa, Homo sapiens
GLAEHLSPLML

SEQ ID NO: 8154 - protein, 11 aa, Homo sapiens
GLAEVMAGLGV

SEQ ID NO: 8155 - protein, 11 aa, Homo sapiens
GLAGAGNSVLL

SEQ ID NO: 8156 - protein, 9 aa, Homo sapiens
GLAGLATDV

SEQ ID NO: 8157 - protein, 11 aa, Homo sapiens
GLAGLGDVAEV

SEQ ID NO: 8158 - protein, 9 aa, Homo sapiens
GLAGLIGLA

SEQ ID NO: 8159 - protein, 10 aa, Homo sapiens
GLAGLIGLAV

SEQ ID NO: 8160 - protein, 12 aa, Homo sapiens
GLAGQLLSDILA

SEQ ID NO: 8161 - protein, 9 aa, Homo sapiens
GLALLLPPV

SEQ ID NO: 8162 - protein, 10 aa, Homo sapiens
GLALLLPPVT

SEQ ID NO: 8163 - protein, 11 aa, Homo sapiens
GLALLLPPVTL

SEQ ID NO: 8164 - protein, 12 aa, Homo sapiens
GLALLLPPVTLA

SEQ ID NO: 8165 - protein, 10 aa, Homo sapiens
GLAPFSFPQV

SEQ ID NO: 8166 - protein, 11 aa, Homo sapiens
GLAPVEVEELL

SEQ ID NO: 8167 - protein, 10 aa, Homo sapiens
GLAPVPMIIF

SEQ ID NO: 8168 - protein, 11 aa, Homo sapiens
GLAPVPMIIFA

SEQ ID NO: 8169 - protein, 10 aa, Homo sapiens
GLASAPIEEV

SEQ ID NO: 8170 - protein, 12 aa, Homo sapiens
GLASICNGGGGA

SEQ ID NO: 8171 - protein, 10 aa, Homo sapiens
GLASLEQLYL

SEQ ID NO: 8172 - protein, 9 aa, Homo sapiens
GLASVEPYV

SEQ ID NO: 8173 - protein, 9 aa, Homo sapiens
GLATEPESV

SEQ ID NO: 8174 - protein, 11 aa, Homo sapiens
GLATGIAGGLA

SEQ ID NO: 8175 - protein, 10 aa, Homo sapiens
GLAVEGPSEA

SEQ ID NO: 8176 - protein, 9 aa, Homo sapiens
GLDDDEPSL

SEQ ID NO: 8177 - protein, 10 aa, Homo sapiens
GLDEAKEILL

SEQ ID NO: 8178 - protein, 10 aa, Homo sapiens
GLDEDETNFL

SEQ ID NO: 8179 - protein, 10 aa, Homo sapiens
GLDEEAEQKL

SEQ ID NO: 8180 - protein, 12 aa, Homo sapiens
GLDEIDHAEMEL

SEQ ID NO: 8181 - protein, 8 aa, Homo sapiens
GLDELFVQ

SEQ ID NO: 8182 - protein, 8 aa, Homo sapiens
GLDFEAIL

SEQ ID NO: 8183 - protein, 9 aa, Homo sapiens
GLDFSLPGM

SEQ ID NO: 8184 - protein, 11 aa, Homo sapiens
GLDGEIGNFEV

SEQ ID NO: 8185 - protein, 10 aa, Homo sapiens
GLDGGLPEEV

SEQ ID NO: 8186 - protein, 9 aa, Homo sapiens
GLDGSLVFL

SEQ ID NO: 8187 - protein, 11 aa, Homo sapiens
GLDIESSLKQL

SEQ ID NO: 8188 - protein, 11 aa, Homo sapiens
GLDISHISQRL

SEQ ID NO: 8189 - protein, 9 aa, Homo sapiens
GLDKSEDKV

SEQ ID NO: 8190 - protein, 8 aa, Homo sapiens
GLDNIILF

SEQ ID NO: 8191 - protein, 9 aa, Homo sapiens
GLDNIILFL

SEQ ID NO: 8192 - protein, 9 aa, Homo sapiens
GLDPARVNV

SEQ ID NO: 8193 - protein, 10 aa, Homo sapiens
GLDPVGRIQM

SEQ ID NO: 8194 - protein, 9 aa, Homo sapiens
GLDSSLVAA

SEQ ID NO: 8195 - protein, 9 aa, Homo sapiens
GLDVPQVSL

SEQ ID NO: 8196 - protein, 9 aa, Homo sapiens
GLDWGMEEV

SEQ ID NO: 8197 - protein, 9 aa, Homo sapiens
GLDWLANQL

SEQ ID NO: 8198 - protein, 9 aa, Homo sapiens
GLEDEMYEV

SEQ ID NO: 8199 - protein, 9 aa, Homo sapiens
GLEEMVEEL

SEQ ID NO: 8200 - protein, 8 aa, Homo sapiens
GLFAPLVF

SEQ ID NO: 8201 - protein, 9 aa, Homo sapiens
GLFAPLVFL

SEQ ID NO: 8202 - protein, 10 aa, Homo sapiens
GLFDEEMNEI

SEQ ID NO: 8203 - protein, 11 aa, Homo sapiens
GLFDPSNVKGL

SEQ ID NO: 8204 - protein, 12 aa, Homo sapiens
GLFDSPPGSDDA

SEQ ID NO: 8205 - protein, 11 aa, Homo sapiens
GLFEDPWLLRV

SEQ ID NO: 8206 - protein, 9 aa, Homo sapiens
GLFEGDEYA

SEQ ID NO: 8207 - protein, 10 aa, Homo sapiens
GLFEGDEYAT

SEQ ID NO: 8208 - protein, 11 aa, Homo sapiens
GLFEGDEYATL

SEQ ID NO: 8209 - protein, 12 aa, Homo sapiens
GLFEGDEYATLM

SEQ ID NO: 8210 - protein, 12 aa, Homo sapiens
GLFEPGDMKYEI

SEQ ID NO: 8211 - protein, 12 aa, Homo sapiens
GLFEPGDMQYEL

SEQ ID NO: 8212 - protein, 12 aa, Homo sapiens
GLFEPGDTKYEI

SEQ ID NO: 8213 - protein, 11 aa, Homo sapiens
GLFEQRVEQYL

SEQ ID NO: 8214 - protein, 12 aa, Homo sapiens
GLFFPGSGGVIT

SEQ ID NO: 8215 - protein, 12 aa, Homo sapiens
GLFGGAGVGKTV

SEQ ID NO: 8216 - protein, 10 aa, Homo sapiens
GLFGKTVPKT

SEQ ID NO: 8217 - protein, 9 aa, Homo sapiens
GLFHFPTPL

SEQ ID NO: 8218 - protein, 11 aa, Homo sapiens
GLFHLGEFVNV

SEQ ID NO: 8219 - protein, 11 aa, Homo sapiens
GLFPNNYVTKI

SEQ ID NO: 8220 - protein, 10 aa, Homo sapiens
GLFQGQNSLL

SEQ ID NO: 8221 - protein, 9 aa, Homo sapiens
GLFTVLYTV

SEQ ID NO: 8222 - protein, 9 aa, Homo sapiens
GLGAFGFQL

SEQ ID NO: 8223 - protein, 9 aa, Homo sapiens
GLGELLRSL

SEQ ID NO: 8224 - protein, 9 aa, Homo sapiens
GLGGFGLEL

SEQ ID NO: 8225 - protein, 10 aa, Homo sapiens
GLGGFGLELA

SEQ ID NO: 8226 - protein, 9 aa, Homo sapiens
GLHEDLNRV

SEQ ID NO: 8227 - protein, 10 aa, Homo sapiens
GLHETQPPSV

SEQ ID NO: 8228 - protein, 11 aa, Homo sapiens
GLHFFNPVPVM

SEQ ID NO: 8229 - protein, 10 aa, Homo sapiens
GLHPQIIIRA

SEQ ID NO: 8230 - protein, 9 aa, Homo sapiens
GLHRYLHLL

SEQ ID NO: 8231 - protein, 9 aa, Homo sapiens
GLHSDSHSL

SEQ ID NO: 8232 - protein, 9 aa, Homo sapiens
GLHSLPPEV

SEQ ID NO: 8233 - protein, 9 aa, Homo sapiens
GLIAGVVSI

SEQ ID NO: 8234 - protein, 11 aa, Homo sapiens
GLIDDGETPEA

SEQ ID NO: 8235 - protein, 9 aa, Homo sapiens
GLIDELNQA

SEQ ID NO: 8236 - protein, 10 aa, Homo sapiens
GLIDELNQAL

SEQ ID NO: 8237 - protein, 12 aa, Homo sapiens
GLIDELNQALKI

SEQ ID NO: 8238 - protein, 11 aa, Homo sapiens
GLIDENPGLQL

SEQ ID NO: 8239 - protein, 9 aa, Homo sapiens
GLIDFAIQL

SEQ ID NO: 8240 - protein, 12 aa, Homo sapiens
GLIDGVVEADLV

SEQ ID NO: 8241 - protein, 11 aa, Homo sapiens
GLIDHQTYLEL

SEQ ID NO: 8242 - protein, 11 aa, Homo sapiens
GLIDWNMFVKL

SEQ ID NO: 8243 - protein, 9 aa, Homo sapiens
GLIDYNQLA

SEQ ID NO: 8244 - protein, 10 aa, Homo sapiens
GLIDYNQLAL

SEQ ID NO: 8245 - protein, 9 aa, Homo sapiens
GLIEDYEAL

SEQ ID NO: 8246 - protein, 11 aa, Homo sapiens
GLIEEDDVILL

SEQ ID NO: 8247 - protein, 9 aa, Homo sapiens
GLIEELVDV

SEQ ID NO: 8248 - protein, 9 aa, Homo sapiens
GLIEIISNA

SEQ ID NO: 8249 - protein, 9 aa, Homo sapiens
GLIEWLENT

SEQ ID NO: 8250 - protein, 10 aa, Homo sapiens
GLIEWLENTV

SEQ ID NO: 8251 - protein, 11 aa, Homo sapiens
GLIGNANMVGL

SEQ ID NO: 8252 - protein, 10 aa, Homo sapiens
GLIGVAFVDM

SEQ ID NO: 8253 - protein, 11 aa, Homo sapiens
GLIGVAFVDML

SEQ ID NO: 8254 - protein, 12 aa, Homo sapiens
GLILGMGGQTAL

SEQ ID NO: 8255 - protein, 9 aa, Homo sapiens
GLISFQEFV

SEQ ID NO: 8256 - protein, 9 aa, Homo sapiens
GLISILEPV

SEQ ID NO: 8257 - protein, 9 aa, Homo sapiens
GLISNSPVL

SEQ ID NO: 8258 - protein, 10 aa, Homo sapiens
GLISVALTKV

SEQ ID NO: 8259 - protein, 11 aa, Homo sapiens
GLISVSNLPKL

SEQ ID NO: 8260 - protein, 12 aa, Homo sapiens
GLITAGAQLVEL

SEQ ID NO: 8261 - protein, 9 aa, Homo sapiens
GLKELSDFL

SEQ ID NO: 8262 - protein, 11 aa, Homo sapiens
GLKEMDNAGQL

SEQ ID NO: 8263 - protein, 12 aa, Homo sapiens
GLKEMDNAGQLV

SEQ ID NO: 8264 - protein, 11 aa, Homo sapiens
GLKENDVIISI

SEQ ID NO: 8265 - protein, 9 aa, Homo sapiens
GLKLTVEEA

SEQ ID NO: 8266 - protein, 11 aa, Homo sapiens
GLKNGVPAVGL

SEQ ID NO: 8267 - protein, 9 aa, Homo sapiens
GLLDFLQGL

SEQ ID NO: 8268 - protein, 10 aa, Homo sapiens
GLLDIYGFEV

SEQ ID NO: 8269 - protein, 11 aa, Homo sapiens
GLLDMNKGLSL

SEQ ID NO: 8270 - protein, 12 aa, Homo sapiens
GLLDNHSSEFNV

SEQ ID NO: 8271 - protein, 9 aa, Homo sapiens
GLLDSILSV

SEQ ID NO: 8272 - protein, 10 aa, Homo sapiens
GLLDTQTSQV

SEQ ID NO: 8273 - protein, 9 aa, Homo sapiens
GLLEELKTV

SEQ ID NO: 8274 - protein, 9 aa, Homo sapiens
GLLEEQYFE

SEQ ID NO: 8275 - protein, 9 aa, Homo sapiens
GLLEGDYEV

SEQ ID NO: 8276 - protein, 10 aa, Homo sapiens
GLLEGTFPNT

SEQ ID NO: 8277 - protein, 9 aa, Homo sapiens
GLLEIVTSV

SEQ ID NO: 8278 - protein, 10 aa, Homo sapiens
GLLELTQVEV

SEQ ID NO: 8279 - protein, 9 aa, Homo sapiens
GLLESVYEM

SEQ ID NO: 8280 - protein, 10 aa, Homo sapiens
GLLETDEATL

SEQ ID NO: 8281 - protein, 12 aa, Homo sapiens
GLLETDEATLDT

SEQ ID NO: 8282 - protein, 12 aa, Homo sapiens
GLLEWESKSDAL

SEQ ID NO: 8283 - protein, 11 aa, Homo sapiens
GLLGDAFLHLI

SEQ ID NO: 8284 - protein, 9 aa, Homo sapiens
GLLGGVIMM

SEQ ID NO: 8285 - protein, 10 aa, Homo sapiens
GLLGGVIMMV

SEQ ID NO: 8286 - protein, 9 aa, Homo sapiens
GLLGGWTVL

SEQ ID NO: 8287 - protein, 10 aa, Homo sapiens
GLLGGWTVLL

SEQ ID NO: 8288 - protein, 11 aa, Homo sapiens
GLLGISKGGEL

SEQ ID NO: 8289 - protein, 9 aa, Homo sapiens
GLLGIYQEL

SEQ ID NO: 8290 - protein, 10 aa, Homo sapiens
GLLGIYQELL

SEQ ID NO: 8291 - protein, 12 aa, Homo sapiens
GLLGLFQGQNSL

SEQ ID NO: 8292 - protein, 9 aa, Homo sapiens
GLLGLQNLL

SEQ ID NO: 8293 - protein, 11 aa, Homo sapiens
GLLGQPEATMV

SEQ ID NO: 8294 - protein, 9 aa, Homo sapiens
GLLHRAFSV

SEQ ID NO: 8295 - protein, 10 aa, Homo sapiens
GLLKLNPVGA

SEQ ID NO: 8296 - protein, 10 aa, Homo sapiens
GLLLVTGPLV

SEQ ID NO: 8297 - protein, 11 aa, Homo sapiens
GLLLVTGPLVL

SEQ ID NO: 8298 - protein, 12 aa, Homo sapiens
GLLPATVQPFHL

SEQ ID NO: 8299 - protein, 11 aa, Homo sapiens
GLLPEELTPLI

SEQ ID NO: 8300 - protein, 12 aa, Homo sapiens
GLLPEELTPLIL

SEQ ID NO: 8301 - protein, 11 aa, Homo sapiens
GLLPPLRIPEL

SEQ ID NO: 8302 - protein, 12 aa, Homo sapiens
GLLPPLRIPELL

SEQ ID NO: 8303 - protein, 9 aa, Homo sapiens
GLLPQLLGV

SEQ ID NO: 8304 - protein, 10 aa, Homo sapiens
GLLPTPNPLT

SEQ ID NO: 8305 - protein, 12 aa, Homo sapiens
GLLPTPNPLTQI

SEQ ID NO: 8306 - protein, 11 aa, Homo sapiens
GLLPVLGQPII

SEQ ID NO: 8307 - protein, 12 aa, Homo sapiens
GLLQGKLALLSV

SEQ ID NO: 8308 - protein, 9 aa, Homo sapiens
GLLRATTAA

SEQ ID NO: 8309 - protein, 12 aa, Homo sapiens
GLLRATTAALLL

SEQ ID NO: 8310 - protein, 10 aa, Homo sapiens
GLLSAEVARL

SEQ ID NO: 8311 - protein, 11 aa, Homo sapiens
GLLSAEVARLL

SEQ ID NO: 8312 - protein, 12 aa, Homo sapiens
GLLSAEVARLLL

SEQ ID NO: 8313 - protein, 12 aa, Homo sapiens
GLLSDPLSDLQL

SEQ ID NO: 8314 - protein, 9 aa, Homo sapiens
GLLSDVVPF

SEQ ID NO: 8315 - protein, 11 aa, Homo sapiens
GLLSDVVPFKV

SEQ ID NO: 8316 - protein, 9 aa, Homo sapiens
GLLSEEVEL

SEQ ID NO: 8317 - protein, 9 aa, Homo sapiens
GLLSPHPLL

SEQ ID NO: 8318 - protein, 11 aa, Homo sapiens
GLLSPHPLLQL

SEQ ID NO: 8319 - protein, 9 aa, Homo sapiens
GLMAEEVQA

SEQ ID NO: 8320 - protein, 10 aa, Homo sapiens
GLMAEEVQAV

SEQ ID NO: 8321 - protein, 12 aa, Homo sapiens
GLMDGKGGGKDV

SEQ ID NO: 8322 - protein, 12 aa, Homo sapiens
GLMDTTLEEVFL

SEQ ID NO: 8323 - protein, 10 aa, Homo sapiens
GLMEEMSALL

SEQ ID NO: 8324 - protein, 11 aa, Homo sapiens
GLMEEMSALLA

SEQ ID NO: 8325 - protein, 12 aa, Homo sapiens
GLMGAGIAQVSV

SEQ ID NO: 8326 - protein, 10 aa, Homo sapiens
GLMLQDLVSA

SEQ ID NO: 8327 - protein, 10 aa, Homo sapiens
GLMPPPEPKV

SEQ ID NO: 8328 - protein, 11 aa, Homo sapiens
GLMTGSGVVGV

SEQ ID NO: 8329 - protein, 8 aa, Homo sapiens
GLMTTVHA

SEQ ID NO: 8330 - protein, 10 aa, Homo sapiens
GLMTTVHAIT

SEQ ID NO: 8331 - protein, 12 aa, Homo sapiens
GLMTTVHAITAT

SEQ ID NO: 8332 - protein, 11 aa, Homo sapiens
GLNEILSDPEV

SEQ ID NO: 8333 - protein, 12 aa, Homo sapiens
GLNEILSDPEVL

SEQ ID NO: 8334 - protein, 11 aa, Homo sapiens
GLNPISTVTEL

SEQ ID NO: 8335 - protein, 10 aa, Homo sapiens
GLNQAATELV

SEQ ID NO: 8336 - protein, 10 aa, Homo sapiens
GLNTLSSFML

SEQ ID NO: 8337 - protein, 9 aa, Homo sapiens
GLPFPFPDI

SEQ ID NO: 8338 - protein, 11 aa, Homo sapiens
GLPPILNALEV

SEQ ID NO: 8339 - protein, 10 aa, Homo sapiens
GLPSGAPPGV

SEQ ID NO: 8340 - protein, 10 aa, Homo sapiens
GLQDVLRTNL

SEQ ID NO: 8341 - protein, 12 aa, Homo sapiens
GLQEAGEEDTRL

SEQ ID NO: 8342 - protein, 10 aa, Homo sapiens
GLQEAINDLV

SEQ ID NO: 8343 - protein, 9 aa, Homo sapiens
GLQEYVEAV

SEQ ID NO: 8344 - protein, 11 aa, Homo sapiens
GLQEYVEAVSF

SEQ ID NO: 8345 - protein, 9 aa, Homo sapiens
GLQFPVGRV

SEQ ID NO: 8346 - protein, 11 aa, Homo sapiens
GLQGALLTHFL

SEQ ID NO: 8347 - protein, 11 aa, Homo sapiens
GLQGGIPNGYL

SEQ ID NO: 8348 - protein, 11 aa, Homo sapiens
GLQGGSAGSPA

SEQ ID NO: 8349 - protein, 9 aa, Homo sapiens
GLQNDLFSL

SEQ ID NO: 8350 - protein, 10 aa, Homo sapiens
GLQNDLFSLA

SEQ ID NO: 8351 - protein, 9 aa, Homo sapiens
GLQQYYVKL

SEQ ID NO: 8352 - protein, 9 aa, Homo sapiens
GLQSQIAQV

SEQ ID NO: 8353 - protein, 10 aa, Homo sapiens
GLQVVEKQNL

SEQ ID NO: 8354 - protein, 9 aa, Homo sapiens
GLREENEGV

SEQ ID NO: 8355 - protein, 11 aa, Homo sapiens
GLRNVQAEEMV

SEQ ID NO: 8356 - protein, 9 aa, Homo sapiens
GLSAAPVPT

SEQ ID NO: 8357 - protein, 8 aa, Homo sapiens
GLSEAQVM

SEQ ID NO: 8358 - protein, 9 aa, Homo sapiens
GLSEAQVMM

SEQ ID NO: 8359 - protein, 10 aa, Homo sapiens
GLSEDTTEET

SEQ ID NO: 8360 - protein, 11 aa, Homo sapiens
GLSEDTTEETL

SEQ ID NO: 8361 - protein, 10 aa, Homo sapiens
GLSEEAIMEL

SEQ ID NO: 8362 - protein, 9 aa, Homo sapiens
GLSESSVKV

SEQ ID NO: 8363 - protein, 10 aa, Homo sapiens
GLSGPPPPNA

SEQ ID NO: 8364 - protein, 10 aa, Homo sapiens
GLSGSGPAYA

SEQ ID NO: 8365 - protein, 11 aa, Homo sapiens
GLSKDDIENMV

SEQ ID NO: 8366 - protein, 9 aa, Homo sapiens
GLSKLSPST

SEQ ID NO: 8367 - protein, 10 aa, Homo sapiens
GLSPATPTPA

SEQ ID NO: 8368 - protein, 9 aa, Homo sapiens
GLSPGMVRA

SEQ ID NO: 8369 - protein, 10 aa, Homo sapiens
GLSPPVAIFF

SEQ ID NO: 8370 - protein, 11 aa, Homo sapiens
GLSPPVAIFFV

SEQ ID NO: 8371 - protein, 9 aa, Homo sapiens
GLSSDLQQV

SEQ ID NO: 8372 - protein, 11 aa, Homo sapiens
GLSSIANLPKL

SEQ ID NO: 8373 - protein, 10 aa, Homo sapiens
GLSSMQGWRV

SEQ ID NO: 8374 - protein, 9 aa, Homo sapiens
GLSVYQIKV

SEQ ID NO: 8375 - protein, 9 aa, Homo sapiens
GLTAEFVNL

SEQ ID NO: 8376 - protein, 9 aa, Homo sapiens
GLTDEFEEL

SEQ ID NO: 8377 - protein, 9 aa, Homo sapiens
GLTDEINFL

SEQ ID NO: 8378 - protein, 9 aa, Homo sapiens
GLTDQINFL

SEQ ID NO: 8379 - protein, 10 aa, Homo sapiens
GLTEAQTREL

SEQ ID NO: 8380 - protein, 8 aa, Homo sapiens
GLTEDMVT

SEQ ID NO: 8381 - protein, 9 aa, Homo sapiens
GLTEDMVTV

SEQ ID NO: 8382 - protein, 9 aa, Homo sapiens
GLTGKPVMV

SEQ ID NO: 8383 - protein, 11 aa, Homo sapiens
GLTSIANLPKL

SEQ ID NO: 8384 - protein, 10 aa, Homo sapiens
GLTSVINQKL

SEQ ID NO: 8385 - protein, 9 aa, Homo sapiens
GLTSVKINV

SEQ ID NO: 8386 - protein, 9 aa, Homo sapiens
GLTTRTIGV

SEQ ID NO: 8387 - protein, 9 aa, Homo sapiens
GLTVSIPGL

SEQ ID NO: 8388 - protein, 11 aa, Homo sapiens
GLVDAEALVAL

SEQ ID NO: 8389 - protein, 9 aa, Homo sapiens
GLVDFVQEV

SEQ ID NO: 8390 - protein, 11 aa, Homo sapiens
GLVDFVQEVNV

SEQ ID NO: 8391 - protein, 9 aa, Homo sapiens
GLVGLEPAT

SEQ ID NO: 8392 - protein, 10 aa, Homo sapiens
GLVGLEPATL

SEQ ID NO: 8393 - protein, 11 aa, Homo sapiens
GLVGPEFHEKL

SEQ ID NO: 8394 - protein, 9 aa, Homo sapiens
GLVGVDQFL

SEQ ID NO: 8395 - protein, 10 aa, Homo sapiens
GLVGVDQFLV

SEQ ID NO: 8396 - protein, 9 aa, Homo sapiens
GLVGVNLTL

SEQ ID NO: 8397 - protein, 9 aa, Homo sapiens
GLVKDSPLL

SEQ ID NO: 8398 - protein, 12 aa, Homo sapiens
GLVKYMNSGPVV

SEQ ID NO: 8399 - protein, 9 aa, Homo sapiens
GLVQGTTPV

SEQ ID NO: 8400 - protein, 9 aa, Homo sapiens
GLVSTGLKV

SEQ ID NO: 8401 - protein, 12 aa, Homo sapiens
GLWDAFSNEEAV

SEQ ID NO: 8402 - protein, 11 aa, Homo sapiens
GLWEIDNNPKV

SEQ ID NO: 8403 - protein, 10 aa, Homo sapiens
GLWEIENNPT

SEQ ID NO: 8404 - protein, 11 aa, Homo sapiens
GLWEIQNNPHA

SEQ ID NO: 8405 - protein, 9 aa, Homo sapiens
GLWFHPEEL

SEQ ID NO: 8406 - protein, 8 aa, Homo sapiens
GLWGHALL

SEQ ID NO: 8407 - protein, 9 aa, Homo sapiens
GLWGHPVLA

SEQ ID NO: 8408 - protein, 12 aa, Homo sapiens
GLWGPEEEPHLL

SEQ ID NO: 8409 - protein, 11 aa, Homo sapiens
GLWLVAQQPAL

SEQ ID NO: 8410 - protein, 11 aa, Homo sapiens
GLWPGAGTIRL

SEQ ID NO: 8411 - protein, 10 aa, Homo sapiens
GLYADYLFNA

SEQ ID NO: 8412 - protein, 10 aa, Homo sapiens
GLYALGLIHA

SEQ ID NO: 8413 - protein, 11 aa, Homo sapiens
GLYDVVSVLRI

SEQ ID NO: 8414 - protein, 10 aa, Homo sapiens
GLYEGLDWLS

SEQ ID NO: 8415 - protein, 9 aa, Homo sapiens
GLYGIKDDV

SEQ ID NO: 8416 - protein, 12 aa, Homo sapiens
GLYGIKDDVFLS

SEQ ID NO: 8417 - protein, 9 aa, Homo sapiens
GLYGLIVAL

SEQ ID NO: 8418 - protein, 9 aa, Homo sapiens
GLYGSHLYV

SEQ ID NO: 8419 - protein, 10 aa, Homo sapiens
GLYSKTMTPT

SEQ ID NO: 8420 - protein, 9 aa, Homo sapiens
GLYSRQLYV

SEQ ID NO: 8421 - protein, 11 aa, Homo sapiens
GMADYSDPSYV

SEQ ID NO: 8422 - protein, 9 aa, Homo sapiens
GMAFRVPTA

SEQ ID NO: 8423 - protein, 9 aa, Homo sapiens
GMAFTFLKV

SEQ ID NO: 8424 - protein, 12 aa, Homo sapiens
GMDELSEEDKLT

SEQ ID NO: 8425 - protein, 8 aa, Homo sapiens
GMDYDYAL

SEQ ID NO: 8426 - protein, 9 aa, Homo sapiens
GMDYDYALL

SEQ ID NO: 8427 - protein, 11 aa, Homo sapiens
GMESMSNVPYV

SEQ ID NO: 8428 - protein, 9 aa, Homo sapiens
GMFGKETYV

SEQ ID NO: 8429 - protein, 10 aa, Homo sapiens
GMGGITAVTV

SEQ ID NO: 8430 - protein, 9 aa, Homo sapiens
GMIDEEFTV

SEQ ID NO: 8431 - protein, 11 aa, Homo sapiens
GMLPANYVEAI

SEQ ID NO: 8432 - protein, 9 aa, Homo sapiens
GMMSTVTEV

SEQ ID NO: 8433 - protein, 9 aa, Homo sapiens
GMNDMNHEV

SEQ ID NO: 8434 - protein, 10 aa, Homo sapiens
GMNQFKPIFL

SEQ ID NO: 8435 - protein, 10 aa, Homo sapiens
GMVPFVFVGT

SEQ ID NO: 8436 - protein, 9 aa, Homo sapiens
GMWGSSVFL

SEQ ID NO: 8437 - protein, 9 aa, Homo sapiens
GMYGIENEV

SEQ ID NO: 8438 - protein, 10 aa, Homo sapiens
GMYGIENEVF

SEQ ID NO: 8439 - protein, 11 aa, Homo sapiens
GMYGIENEVFL

SEQ ID NO: 8440 - protein, 10 aa, Homo sapiens
GMYSLPFLTA

SEQ ID NO: 8441 - protein, 9 aa, Homo sapiens
GQAPSVFSV

SEQ ID NO: 8442 - protein, 11 aa, Homo sapiens
GQDEMIDVIGV

SEQ ID NO: 8443 - protein, 9 aa, Homo sapiens
GQDEPLIHV

SEQ ID NO: 8444 - protein, 9 aa, Homo sapiens
GQEESQVSV

SEQ ID NO: 8445 - protein, 10 aa, Homo sapiens
GQFQGRPVSV

SEQ ID NO: 8446 - protein, 9 aa, Homo sapiens
GQHKDAYQV

SEQ ID NO: 8447 - protein, 9 aa, Homo sapiens
GQICRVTTV

SEQ ID NO: 8448 - protein, 11 aa, Homo sapiens
GQISGLNVLRV

SEQ ID NO: 8449 - protein, 9 aa, Homo sapiens
GQLAEVHSV

SEQ ID NO: 8450 - protein, 9 aa, Homo sapiens
GQLEFRALL

SEQ ID NO: 8451 - protein, 9 aa, Homo sapiens
GQLEILEFL

SEQ ID NO: 8452 - protein, 9 aa, Homo sapiens
GQLNGFHEA

SEQ ID NO: 8453 - protein, 11 aa, Homo sapiens
GQNGISDLVKV

SEQ ID NO: 8454 - protein, 9 aa, Homo sapiens
GQNPTNAEV

SEQ ID NO: 8455 - protein, 11 aa, Homo sapiens
GQPAEEIFESV

SEQ ID NO: 8456 - protein, 10 aa, Homo sapiens
GQPAQPAPMV

SEQ ID NO: 8457 - protein, 10 aa, Homo sapiens
GQQELADLFV

SEQ ID NO: 8458 - protein, 9 aa, Homo sapiens
GQSEEEASI

SEQ ID NO: 8459 - protein, 12 aa, Homo sapiens
GQVEVTGDEYNV

SEQ ID NO: 8460 - protein, 9 aa, Homo sapiens
GQWASVIRV

SEQ ID NO: 8461 - protein, 12 aa, Homo sapiens
GQWDPADPAPSA

SEQ ID NO: 8462 - protein, 10 aa, Homo sapiens
GQYEGKVSSV

SEQ ID NO: 8463 - protein, 10 aa, Homo sapiens
GQYGLDVVQA

SEQ ID NO: 8464 - protein, 10 aa, Homo sapiens
GTAENGIHPL

SEQ ID NO: 8465 - protein, 10 aa, Homo sapiens
GTFDISILEI

SEQ ID NO: 8466 - protein, 9 aa, Homo sapiens
GTFDVSILT

SEQ ID NO: 8467 - protein, 10 aa, Homo sapiens
GTFEWVDSML

SEQ ID NO: 8468 - protein, 10 aa, Homo sapiens
GTMDGANVEM

SEQ ID NO: 8469 - protein, 12 aa, Homo sapiens
GVAELLFNTIQA

SEQ ID NO: 8470 - protein, 11 aa, Homo sapiens
GVAGLAGLIGL

SEQ ID NO: 8471 - protein, 11 aa, Homo sapiens
GVALSNVIHKV

SEQ ID NO: 8472 - protein, 9 aa, Homo sapiens
GVDEEPQHV

SEQ ID NO: 8473 - protein, 9 aa, Homo sapiens
GVDSLITLA

SEQ ID NO: 8474 - protein, 9 aa, Homo sapiens
GVDVTLPRV

SEQ ID NO: 8475 - protein, 9 aa, Homo sapiens
GVFEWEAFA

SEQ ID NO: 8476 - protein, 9 aa, Homo sapiens
GVGAVNISV

SEQ ID NO: 8477 - protein, 9 aa, Homo sapiens
GVIAGLNVL

SEQ ID NO: 8478 - protein, 10 aa, Homo sapiens
GVLAGDVTDV

SEQ ID NO: 8479 - protein, 12 aa, Homo sapiens
GVLAGDVTDVLL

SEQ ID NO: 8480 - protein, 11 aa, Homo sapiens
GVLDEQELEAL

SEQ ID NO: 8481 - protein, 9 aa, Homo sapiens
GVLDFLEEV

SEQ ID NO: 8482 - protein, 10 aa, Homo sapiens
GVLDGVLMEL

SEQ ID NO: 8483 - protein, 9 aa, Homo sapiens
GVLENIFGV

SEQ ID NO: 8484 - protein, 10 aa, Homo sapiens
GVLGLDLWQV

SEQ ID NO: 8485 - protein, 10 aa, Homo sapiens
GVLGNALEGV

SEQ ID NO: 8486 - protein, 11 aa, Homo sapiens
GVLQDKDLFSV

SEQ ID NO: 8487 - protein, 9 aa, Homo sapiens
GVMDGVPSA

SEQ ID NO: 8488 - protein, 9 aa, Homo sapiens
GVMEYDLSL

SEQ ID NO: 8489 - protein, 9 aa, Homo sapiens
GVMLAVDAV

SEQ ID NO: 8490 - protein, 9 aa, Homo sapiens
GVMPEIAQA

SEQ ID NO: 8491 - protein, 9 aa, Homo sapiens
GVMSGAVPA

SEQ ID NO: 8492 - protein, 10 aa, Homo sapiens
GVMSGAVPAA

SEQ ID NO: 8493 - protein, 9 aa, Homo sapiens
GVNTVTTLV

SEQ ID NO: 8494 - protein, 9 aa, Homo sapiens
GVQGFEALL

SEQ ID NO: 8495 - protein, 9 aa, Homo sapiens
GVTEVVVKL

SEQ ID NO: 8496 - protein, 9 aa, Homo sapiens
GVVEVTHDL

SEQ ID NO: 8497 - protein, 9 aa, Homo sapiens
GVYGDVQRV

SEQ ID NO: 8498 - protein, 12 aa, Homo sapiens
GVYGGDEVGALV

SEQ ID NO: 8499 - protein, 11 aa, Homo sapiens
HIADLAGNSEV

SEQ ID NO: 8500 - protein, 9 aa, Homo sapiens
HIAEVSQEV

SEQ ID NO: 8501 - protein, 9 aa, Homo sapiens
HIMEHLEGV

SEQ ID NO: 8502 - protein, 11 aa, Homo sapiens
HIMPGVGLPEL

SEQ ID NO: 8503 - protein, 9 aa, Homo sapiens
HINKTIAPA

SEQ ID NO: 8504 - protein, 10 aa, Homo sapiens
HISGQHLVAV

SEQ ID NO: 8505 - protein, 11 aa, Homo sapiens
HLAETLSSWEA

SEQ ID NO: 8506 - protein, 10 aa, Homo sapiens
HLAGLGLTEA

SEQ ID NO: 8507 - protein, 9 aa, Homo sapiens
HLAHEVSLA

SEQ ID NO: 8508 - protein, 9 aa, Homo sapiens
HLAKVTAEV

SEQ ID NO: 8509 - protein, 9 aa, Homo sapiens
HLAMNFHEV

SEQ ID NO: 8510 - protein, 11 aa, Homo sapiens
HLAMNFHEVLA

SEQ ID NO: 8511 - protein, 9 aa, Homo sapiens
HLDKISDSV

SEQ ID NO: 8512 - protein, 9 aa, Homo sapiens
HLDKSDPKV

SEQ ID NO: 8513 - protein, 9 aa, Homo sapiens
HLDPSLTHT

SEQ ID NO: 8514 - protein, 9 aa, Homo sapiens
HLDSSGSYV

SEQ ID NO: 8515 - protein, 12 aa, Homo sapiens
HLFDGLDDDEPS

SEQ ID NO: 8516 - protein, 11 aa, Homo sapiens
HLGGEDFDNRL

SEQ ID NO: 8517 - protein, 11 aa, Homo sapiens
HLGGEDFDQRV

SEQ ID NO: 8518 - protein, 8 aa, Homo sapiens
HLGKPPEV

SEQ ID NO: 8519 - protein, 11 aa, Homo sapiens
HLIHEVTKVLL

SEQ ID NO: 8520 - protein, 10 aa, Homo sapiens
HLLDFPNIVI

SEQ ID NO: 8521 - protein, 10 aa, Homo sapiens
HLLDPTVEYV

SEQ ID NO: 8522 - protein, 9 aa, Homo sapiens
HLLGHLEQA

SEQ ID NO: 8523 - protein, 10 aa, Homo sapiens
HLLLEAVPAV

SEQ ID NO: 8524 - protein, 12 aa, Homo sapiens
HLLPSGIINPNV

SEQ ID NO: 8525 - protein, 11 aa, Homo sapiens
HLLSLMGIPYL

SEQ ID NO: 8526 - protein, 9 aa, Homo sapiens
HLNCTISQV

SEQ ID NO: 8527 - protein, 9 aa, Homo sapiens
HLPGFVEQA

SEQ ID NO: 8528 - protein, 11 aa, Homo sapiens
HLQDLMEGLTA

SEQ ID NO: 8529 - protein, 10 aa, Homo sapiens
HLQEGFGCVV

SEQ ID NO: 8530 - protein, 9 aa, Homo sapiens
HLSNIPPSV

SEQ ID NO: 8531 - protein, 9 aa, Homo sapiens
HLTDTSHGV

SEQ ID NO: 8532 - protein, 9 aa, Homo sapiens
HLTWEPPSV

SEQ ID NO: 8533 - protein, 11 aa, Homo sapiens
HLVDPIDDLFL

SEQ ID NO: 8534 - protein, 9 aa, Homo sapiens
HLWAELVFL

SEQ ID NO: 8535 - protein, 12 aa, Homo sapiens
HLYDVFGDPAYL

SEQ ID NO: 8536 - protein, 9 aa, Homo sapiens
HLYPNTPYA

SEQ ID NO: 8537 - protein, 9 aa, Homo sapiens
HLYRGIFPV

SEQ ID NO: 8538 - protein, 9 aa, Homo sapiens
HVDGFIANV

SEQ ID NO: 8539 - protein, 10 aa, Homo sapiens
IIAEDVDGEA

SEQ ID NO: 8540 - protein, 9 aa, Homo sapiens
IIAEGIPEA

SEQ ID NO: 8541 - protein, 10 aa, Homo sapiens
IIAEGIPEAL

SEQ ID NO: 8542 - protein, 10 aa, Homo sapiens
IIDPGSTVTV

SEQ ID NO: 8543 - protein, 9 aa, Homo sapiens
IIHDFQPHV

SEQ ID NO: 8544 - protein, 11 aa, Homo sapiens
IILGGVKAVTL

SEQ ID NO: 8545 - protein, 9 aa, Homo sapiens
IIMDDEFQL

SEQ ID NO: 8546 - protein, 10 aa, Homo sapiens
IISELRNQYV

SEQ ID NO: 8547 - protein, 9 aa, Homo sapiens
IISKFLPPV

SEQ ID NO: 8548 - protein, 10 aa, Homo sapiens
IIYGGSVTGA

SEQ ID NO: 8549 - protein, 11 aa, Homo sapiens
ILAAHVPTLQV

SEQ ID NO: 8550 - protein, 12 aa, Homo sapiens
ILAAHVPTLQVL

SEQ ID NO: 8551 - protein, 9 aa, Homo sapiens
ILADLNLSV

SEQ ID NO: 8552 - protein, 10 aa, Homo sapiens
ILADVLKVEV

SEQ ID NO: 8553 - protein, 11 aa, Homo sapiens
ILADWNEDIEA

SEQ ID NO: 8554 - protein, 9 aa, Homo sapiens
ILAGEIYVM

SEQ ID NO: 8555 - protein, 9 aa, Homo sapiens
ILAGEMLSV

SEQ ID NO: 8556 - protein, 12 aa, Homo sapiens
ILAGSFETAMRL

SEQ ID NO: 8557 - protein, 9 aa, Homo sapiens
ILASFISGL

SEQ ID NO: 8558 - protein, 9 aa, Homo sapiens
ILASVILNV

SEQ ID NO: 8559 - protein, 9 aa, Homo sapiens
ILDAAGANL

SEQ ID NO: 8560 - protein, 9 aa, Homo sapiens
ILDDQTNKL

SEQ ID NO: 8561 - protein, 12 aa, Homo sapiens
ILDEEPIVNRGL

SEQ ID NO: 8562 - protein, 9 aa, Homo sapiens
ILDEIGADV

SEQ ID NO: 8563 - protein, 11 aa, Homo sapiens
ILDEIGADVQA

SEQ ID NO: 8564 - protein, 9 aa, Homo sapiens
ILDELAEKL

SEQ ID NO: 8565 - protein, 11 aa, Homo sapiens
ILDEPTNHLDM

SEQ ID NO: 8566 - protein, 9 aa, Homo sapiens
ILDETLENV

SEQ ID NO: 8567 - protein, 9 aa, Homo sapiens
ILDETVNSV

SEQ ID NO: 8568 - protein, 9 aa, Homo sapiens
ILDKFTEEV

SEQ ID NO: 8569 - protein, 9 aa, Homo sapiens
ILDKYPLAV

SEQ ID NO: 8570 - protein, 9 aa, Homo sapiens
ILDLIQVFV

SEQ ID NO: 8571 - protein, 10 aa, Homo sapiens
ILDMFTEIKV

SEQ ID NO: 8572 - protein, 9 aa, Homo sapiens
ILDMSPFTV

SEQ ID NO: 8573 - protein, 10 aa, Homo sapiens
ILDSGKIVQI

SEQ ID NO: 8574 - protein, 9 aa, Homo sapiens
ILDSIIAQV

SEQ ID NO: 8575 - protein, 9 aa, Homo sapiens
ILDVASLEV

SEQ ID NO: 8576 - protein, 10 aa, Homo sapiens
ILDVLTGINV

SEQ ID NO: 8577 - protein, 8 aa, Homo sapiens
ILEDIQVT

SEQ ID NO: 8578 - protein, 9 aa, Homo sapiens
ILEDIQVTL

SEQ ID NO: 8579 - protein, 11 aa, Homo sapiens
ILEESENLHNA

SEQ ID NO: 8580 - protein, 11 aa, Homo sapiens
ILENKEGLELL

SEQ ID NO: 8581 - protein, 9 aa, Homo sapiens
ILENWNMFV

SEQ ID NO: 8582 - protein, 9 aa, Homo sapiens
ILFDFMDSV

SEQ ID NO: 8583 - protein, 12 aa, Homo sapiens
ILFEQDNEEQSV

SEQ ID NO: 8584 - protein, 9 aa, Homo sapiens
ILFESQFSV

SEQ ID NO: 8585 - protein, 9 aa, Homo sapiens
ILFGMGNPL

SEQ ID NO: 8586 - protein, 10 aa, Homo sapiens
ILFGMGNPLL

SEQ ID NO: 8587 - protein, 12 aa, Homo sapiens
ILFGVYGDVQRV

SEQ ID NO: 8588 - protein, 10 aa, Homo sapiens
ILFLGDGLGV

SEQ ID NO: 8589 - protein, 12 aa, Homo sapiens
ILFLGDGLGVPT

SEQ ID NO: 8590 - protein, 10 aa, Homo sapiens
ILFPGGSVDL

SEQ ID NO: 8591 - protein, 11 aa, Homo sapiens
ILFPPPPPPNI

SEQ ID NO: 8592 - protein, 9 aa, Homo sapiens
ILGATEVKL

SEQ ID NO: 8593 - protein, 9 aa, Homo sapiens
ILGGMIVRI

SEQ ID NO: 8594 - protein, 9 aa, Homo sapiens
ILGGQPPNV

SEQ ID NO: 8595 - protein, 9 aa, Homo sapiens
ILGGSVLHL

SEQ ID NO: 8596 - protein, 8 aa, Homo sapiens
ILGITSPA

SEQ ID NO: 8597 - protein, 9 aa, Homo sapiens
ILGLPQPLL

SEQ ID NO: 8598 - protein, 9 aa, Homo sapiens
ILGNWNMFV

SEQ ID NO: 8599 - protein, 10 aa, Homo sapiens
ILGSFQNIKM

SEQ ID NO: 8600 - protein, 8 aa, Homo sapiens
ILGTAQSV

SEQ ID NO: 8601 - protein, 10 aa, Homo sapiens
ILGYTEHQVV

SEQ ID NO: 8602 - protein, 10 aa, Homo sapiens
ILHDINSDGV

SEQ ID NO: 8603 - protein, 9 aa, Homo sapiens
ILHEHHIFL

SEQ ID NO: 8604 - protein, 9 aa, Homo sapiens
ILHHHIASV

SEQ ID NO: 8605 - protein, 12 aa, Homo sapiens
ILIAGGPGNPAL

SEQ ID NO: 8606 - protein, 12 aa, Homo sapiens
ILIDQGKDDQFL

SEQ ID NO: 8607 - protein, 9 aa, Homo sapiens
ILIDWLVQV

SEQ ID NO: 8608 - protein, 9 aa, Homo sapiens
ILKDGIHNV

SEQ ID NO: 8609 - protein, 9 aa, Homo sapiens
ILLDIHIFM

SEQ ID NO: 8610 - protein, 11 aa, Homo sapiens
ILLDPGALPAL

SEQ ID NO: 8611 - protein, 11 aa, Homo sapiens
ILLELEAPLKI

SEQ ID NO: 8612 - protein, 10 aa, Homo sapiens
ILLENLRFHV

SEQ ID NO: 8613 - protein, 9 aa, Homo sapiens
ILLGATCGL

SEQ ID NO: 8614 - protein, 10 aa, Homo sapiens
ILLGLMGLQV

SEQ ID NO: 8615 - protein, 10 aa, Homo sapiens
ILLNGNNITM

SEQ ID NO: 8616 - protein, 9 aa, Homo sapiens
ILLSQTTGV

SEQ ID NO: 8617 - protein, 10 aa, Homo sapiens
ILLTDGDPTV

SEQ ID NO: 8618 - protein, 8 aa, Homo sapiens
ILLYETAL

SEQ ID NO: 8619 - protein, 9 aa, Homo sapiens
ILLYETALL

SEQ ID NO: 8620 - protein, 11 aa, Homo sapiens
ILMDKPEMNVV

SEQ ID NO: 8621 - protein, 12 aa, Homo sapiens
ILMDKPEMNVVL

SEQ ID NO: 8622 - protein, 9 aa, Homo sapiens
ILMEFLLNV

SEQ ID NO: 8623 - protein, 10 aa, Homo sapiens
ILMGGTVDTV

SEQ ID NO: 8624 - protein, 10 aa, Homo sapiens
ILMGTELTQV

SEQ ID NO: 8625 - protein, 9 aa, Homo sapiens
ILNKLTPQM

SEQ ID NO: 8626 - protein, 11 aa, Homo sapiens
ILNPEEIEKYV

SEQ ID NO: 8627 - protein, 9 aa, Homo sapiens
ILNPHVHLV

SEQ ID NO: 8628 - protein, 11 aa, Homo sapiens
ILNPIANEIYL

SEQ ID NO: 8629 - protein, 10 aa, Homo sapiens
ILNVDGLIGV

SEQ ID NO: 8630 - protein, 9 aa, Homo sapiens
ILPLPGQSV

SEQ ID NO: 8631 - protein, 12 aa, Homo sapiens
ILQDFTGVPAVV

SEQ ID NO: 8632 - protein, 10 aa, Homo sapiens
ILQDGGLQVV

SEQ ID NO: 8633 - protein, 9 aa, Homo sapiens
ILQEAQNLM

SEQ ID NO: 8634 - protein, 9 aa, Homo sapiens
ILQFNLLGV

SEQ ID NO: 8635 - protein, 9 aa, Homo sapiens
ILSELAPSL

SEQ ID NO: 8636 - protein, 10 aa, Homo sapiens
ILSESVVPDV

SEQ ID NO: 8637 - protein, 11 aa, Homo sapiens
ILSGFGGILGL

SEQ ID NO: 8638 - protein, 9 aa, Homo sapiens
ILSHMTHEV

SEQ ID NO: 8639 - protein, 11 aa, Homo sapiens
ILSKYFDLIYV

SEQ ID NO: 8640 - protein, 9 aa, Homo sapiens
ILSPLSVAL

SEQ ID NO: 8641 - protein, 9 aa, Homo sapiens
ILSPTVVSI

SEQ ID NO: 8642 - protein, 8 aa, Homo sapiens
ILSPVQEV

SEQ ID NO: 8643 - protein, 9 aa, Homo sapiens
ILSPWGAEV

SEQ ID NO: 8644 - protein, 9 aa, Homo sapiens
ILTAIIQGM

SEQ ID NO: 8645 - protein, 10 aa, Homo sapiens
ILTDITGHNV

SEQ ID NO: 8646 - protein, 12 aa, Homo sapiens
ILTDITKGVQYL

SEQ ID NO: 8647 - protein, 11 aa, Homo sapiens
ILTDMSRPVEL

SEQ ID NO: 8648 - protein, 11 aa, Homo sapiens
ILTIDDGIFEV

SEQ ID NO: 8649 - protein, 11 aa, Homo sapiens
ILTIEDGIFEV

SEQ ID NO: 8650 - protein, 9 aa, Homo sapiens
ILTMANPII

SEQ ID NO: 8651 - protein, 12 aa, Homo sapiens
ILVDLEPGTMDS

SEQ ID NO: 8652 - protein, 10 aa, Homo sapiens
ILVGDVGQTV

SEQ ID NO: 8653 - protein, 10 aa, Homo sapiens
ILVSDGDPTV

SEQ ID NO: 8654 - protein, 9 aa, Homo sapiens
ILVTLLHTL

SEQ ID NO: 8655 - protein, 11 aa, Homo sapiens
ILWAPDEESGV

SEQ ID NO: 8656 - protein, 12 aa, Homo sapiens
ILWDMSLGKPAA

SEQ ID NO: 8657 - protein, 8 aa, Homo sapiens
ILWPVEIT

SEQ ID NO: 8658 - protein, 9 aa, Homo sapiens
ILWPVEITL

SEQ ID NO: 8659 - protein, 9 aa, Homo sapiens
ILWYFEHQL

SEQ ID NO: 8660 - protein, 11 aa, Homo sapiens
ILYDERSVHKV

SEQ ID NO: 8661 - protein, 10 aa, Homo sapiens
ILYDWINPTY

SEQ ID NO: 8662 - protein, 11 aa, Homo sapiens
ILYDWINPTYL

SEQ ID NO: 8663 - protein, 11 aa, Homo sapiens
ILYGNGPGYKV

SEQ ID NO: 8664 - protein, 12 aa, Homo sapiens
ILYGNGPGYKVV

SEQ ID NO: 8665 - protein, 8 aa, Homo sapiens
ILYRPVAV

SEQ ID NO: 8666 - protein, 12 aa, Homo sapiens
ILYTIDTENSTV

SEQ ID NO: 8667 - protein, 11 aa, Homo sapiens
IMFDGPEAWGV

SEQ ID NO: 8668 - protein, 9 aa, Homo sapiens
IMFDVTSRV

SEQ ID NO: 8669 - protein, 11 aa, Homo sapiens
IMFETFNTPAM

SEQ ID NO: 8670 - protein, 9 aa, Homo sapiens
IMGEAMERV

SEQ ID NO: 8671 - protein, 10 aa, Homo sapiens
IMIDPVLGTV

SEQ ID NO: 8672 - protein, 12 aa, Homo sapiens
IMIDPVLGTVGF

SEQ ID NO: 8673 - protein, 11 aa, Homo sapiens
IMLSEKHLVSV

SEQ ID NO: 8674 - protein, 10 aa, Homo sapiens
IMLTDGDANV

SEQ ID NO: 8675 - protein, 9 aa, Homo sapiens
ITQETLEAL

SEQ ID NO: 8676 - protein, 9 aa, Homo sapiens
IVAPGTFEV

SEQ ID NO: 8677 - protein, 9 aa, Homo sapiens
IVATKPLYV

SEQ ID NO: 8678 - protein, 8 aa, Homo sapiens
IVDPFQIL

SEQ ID NO: 8679 - protein, 9 aa, Homo sapiens
IVDPFQILV

SEQ ID NO: 8680 - protein, 11 aa, Homo sapiens
IVDPNVDEHSV

SEQ ID NO: 8681 - protein, 10 aa, Homo sapiens
IVDPVQPQKV

SEQ ID NO: 8682 - protein, 9 aa, Toxoplasma gondii ME49
IVEGLMTTV

SEQ ID NO: 8683 - protein, 9 aa, Homo sapiens
IVWNGPVGV

SEQ ID NO: 8684 - protein, 11 aa, Homo sapiens
KIFGVTTLDIV

SEQ ID NO: 8685 - protein, 9 aa, Homo sapiens
KIKGDVPSV

SEQ ID NO: 8686 - protein, 9 aa, Homo sapiens
KIMHFPTWV

SEQ ID NO: 8687 - protein, 9 aa, Homo sapiens
KIMQSSSEV

SEQ ID NO: 8688 - protein, 11 aa, Homo sapiens
KISSIQSIVPA

SEQ ID NO: 8689 - protein, 9 aa, Homo sapiens
KITNLTQQL

SEQ ID NO: 8690 - protein, 9 aa, Homo sapiens
KIWDSYFYL

SEQ ID NO: 8691 - protein, 11 aa, Homo sapiens
KIYVDDGLISL

SEQ ID NO: 8692 - protein, 11 aa, Homo sapiens
KLAAIIPDPVV

SEQ ID NO: 8693 - protein, 12 aa, Homo sapiens
KLAALNPESNTA

SEQ ID NO: 8694 - protein, 11 aa, Homo sapiens
KLAEQFPRQVL

SEQ ID NO: 8695 - protein, 9 aa, Homo sapiens
KLAESKVSV

SEQ ID NO: 8696 - protein, 9 aa, Homo sapiens
KLAETTDKV

SEQ ID NO: 8697 - protein, 11 aa, Homo sapiens
KLAQANGWGVM

SEQ ID NO: 8698 - protein, 12 aa, Homo sapiens
KLAQANGWGVMV

SEQ ID NO: 8699 - protein, 10 aa, Homo sapiens
KLAQENGWGV

SEQ ID NO: 8700 - protein, 10 aa, Homo sapiens
KLAQSNGWGV

SEQ ID NO: 8701 - protein, 11 aa, Homo sapiens
KLASVPAGGAV

SEQ ID NO: 8702 - protein, 9 aa, Homo sapiens
KLDADMPEV

SEQ ID NO: 8703 - protein, 11 aa, Homo sapiens
KLDDQSEDEAL

SEQ ID NO: 8704 - protein, 9 aa, Homo sapiens
KLDEAFEFV

SEQ ID NO: 8705 - protein, 8 aa, Homo sapiens
KLDEDYLY

SEQ ID NO: 8706 - protein, 9 aa, Homo sapiens
KLDEDYLYM

SEQ ID NO: 8707 - protein, 10 aa, Homo sapiens
KLDELKRQEV

SEQ ID NO: 8708 - protein, 9 aa, Homo sapiens
KLDENSAFL

SEQ ID NO: 8709 - protein, 9 aa, Homo sapiens
KLDESIYDV

SEQ ID NO: 8710 - protein, 9 aa, Homo sapiens
KLDETGNSL

SEQ ID NO: 8711 - protein, 9 aa, Homo sapiens
KLDIGQYLL

SEQ ID NO: 8712 - protein, 9 aa, Homo sapiens
KLDPHNHVL

SEQ ID NO: 8713 - protein, 11 aa, Homo sapiens
KLDYDEDASAM

SEQ ID NO: 8714 - protein, 12 aa, Homo sapiens
KLDYDEDASAML

SEQ ID NO: 8715 - protein, 9 aa, Homo sapiens
KLDYGQHVV

SEQ ID NO: 8716 - protein, 10 aa, Homo sapiens
KLEEEGEQFV

SEQ ID NO: 8717 - protein, 11 aa, Homo sapiens
KLEGDLTGPSV

SEQ ID NO: 8718 - protein, 9 aa, Homo sapiens
KLFAGINSV

SEQ ID NO: 8719 - protein, 9 aa, Homo sapiens
KLFANIAEV

SEQ ID NO: 8720 - protein, 10 aa, Homo sapiens
KLFDSDPITV

SEQ ID NO: 8721 - protein, 12 aa, Homo sapiens
KLFDSDPITVTV

SEQ ID NO: 8722 - protein, 9 aa, Homo sapiens
KLFSILSTV

SEQ ID NO: 8723 - protein, 10 aa, Homo sapiens
KLFYADHPFI

SEQ ID NO: 8724 - protein, 11 aa, Homo sapiens
KLFYADHPFIF

SEQ ID NO: 8725 - protein, 12 aa, Homo sapiens
KLFYADHPFIFL

SEQ ID NO: 8726 - protein, 12 aa, Homo sapiens
KLGEIVTTIPTI

SEQ ID NO: 8727 - protein, 9 aa, Homo sapiens
KLGPAPKTL

SEQ ID NO: 8728 - protein, 9 aa, Homo sapiens
KLGPDDPNV

SEQ ID NO: 8729 - protein, 9 aa, Homo sapiens
KLGSYEHRI

SEQ ID NO: 8730 - protein, 11 aa, Homo sapiens
KLHVDPENFRL

SEQ ID NO: 8731 - protein, 10 aa, Homo sapiens
KLIAGKIIPA

SEQ ID NO: 8732 - protein, 9 aa, Homo sapiens
KLIFPYVEL

SEQ ID NO: 8733 - protein, 10 aa, Homo sapiens
KLIPGPLSPV

SEQ ID NO: 8734 - protein, 11 aa, Homo sapiens
KLIPGPLSPVA

SEQ ID NO: 8735 - protein, 9 aa, Homo sapiens
KLIPLIFEV

SEQ ID NO: 8736 - protein, 11 aa, Homo sapiens
KLKEAVKEESI

SEQ ID NO: 8737 - protein, 11 aa, Homo sapiens
KLLCGLLAERL

SEQ ID NO: 8738 - protein, 9 aa, Homo sapiens
KLLDGPPGV

SEQ ID NO: 8739 - protein, 11 aa, Homo sapiens
KLLDGPPGVDV

SEQ ID NO: 8740 - protein, 9 aa, Homo sapiens
KLLDILSYL

SEQ ID NO: 8741 - protein, 11 aa, Homo sapiens
KLLDMVGKVQI

SEQ ID NO: 8742 - protein, 10 aa, Homo sapiens
KLLEEATISV

SEQ ID NO: 8743 - protein, 12 aa, Homo sapiens
KLLEEDGTIITL

SEQ ID NO: 8744 - protein, 9 aa, Homo sapiens
KLLEKLYKV

SEQ ID NO: 8745 - protein, 9 aa, Homo sapiens
KLLETKWTL

SEQ ID NO: 8746 - protein, 9 aa, Homo sapiens
KLLGKLPEL

SEQ ID NO: 8747 - protein, 11 aa, Homo sapiens
KLLGQFTLIGI

SEQ ID NO: 8748 - protein, 10 aa, Homo sapiens
KLLPGDIHQI

SEQ ID NO: 8749 - protein, 10 aa, Homo sapiens
KLLQEEVTKV

SEQ ID NO: 8750 - protein, 12 aa, Homo sapiens
KLLTEKDAQIAM

SEQ ID NO: 8751 - protein, 9 aa, Homo sapiens
KLMPGTYTL

SEQ ID NO: 8752 - protein, 11 aa, Homo sapiens
KLMQITSLHSL

SEQ ID NO: 8753 - protein, 11 aa, Homo sapiens
KLNDMEPSKAV

SEQ ID NO: 8754 - protein, 9 aa, Homo sapiens
KLNEINEKI

SEQ ID NO: 8755 - protein, 9 aa, Homo sapiens
KLNENYEEV

SEQ ID NO: 8756 - protein, 9 aa, Homo sapiens
KLNEVIRQV

SEQ ID NO: 8757 - protein, 9 aa, Homo sapiens
KLNNVNNQL

SEQ ID NO: 8758 - protein, 12 aa, Homo sapiens
KLPGAFILGAGA

SEQ ID NO: 8759 - protein, 9 aa, Homo sapiens
KLPPQSSGV

SEQ ID NO: 8760 - protein, 9 aa, Homo sapiens
KLQDFKSFL

SEQ ID NO: 8761 - protein, 9 aa, Homo sapiens
KLQEALKTI

SEQ ID NO: 8762 - protein, 11 aa, Homo sapiens
KLQEESDLELA

SEQ ID NO: 8763 - protein, 9 aa, Homo sapiens
KLQESTQTV

SEQ ID NO: 8764 - protein, 10 aa, Homo sapiens
KLQEVGQVSV

SEQ ID NO: 8765 - protein, 9 aa, Homo sapiens
KLQIVEMPL

SEQ ID NO: 8766 - protein, 10 aa, Homo sapiens
KLQIVEMPLA

SEQ ID NO: 8767 - protein, 9 aa, Homo sapiens
KLQLVEMPL

SEQ ID NO: 8768 - protein, 10 aa, Homo sapiens
KLQLVEMPLA

SEQ ID NO: 8769 - protein, 10 aa, Homo sapiens
KLQPGSVPKI

SEQ ID NO: 8770 - protein, 9 aa, Homo sapiens
KLQSSEAEV

SEQ ID NO: 8771 - protein, 11 aa, Homo sapiens
KLSDGVAVLKV

SEQ ID NO: 8772 - protein, 9 aa, Homo sapiens
KLSEENRHL

SEQ ID NO: 8773 - protein, 9 aa, Homo sapiens
KLSELKETV

SEQ ID NO: 8774 - protein, 10 aa, Homo sapiens
KLSLVAAMLL

SEQ ID NO: 8775 - protein, 11 aa, Homo sapiens
KLSLVAAMLLL

SEQ ID NO: 8776 - protein, 9 aa, Homo sapiens
KLSSAMSAA

SEQ ID NO: 8777 - protein, 9 aa, Homo sapiens
KLSSKLSAV

SEQ ID NO: 8778 - protein, 9 aa, Toxoplasma gondii GT1
KLTGMAFRV

SEQ ID NO: 8779 - protein, 12 aa, Homo sapiens
KLVDQNIFSFYL

SEQ ID NO: 8780 - protein, 9 aa, Homo sapiens
KLVPFATEL

SEQ ID NO: 8781 - protein, 9 aa, Homo sapiens
KLVTDLTKV

SEQ ID NO: 8782 - protein, 9 aa, Homo sapiens
KLWEFFQVD

SEQ ID NO: 8783 - protein, 12 aa, Homo sapiens
KLWTLVSEQTRV

SEQ ID NO: 8784 - protein, 12 aa, Homo sapiens
KLYSPSQIGAFV

SEQ ID NO: 8785 - protein, 10 aa, Homo sapiens
KMASLYNIHL

SEQ ID NO: 8786 - protein, 9 aa, Homo sapiens
KMDHLMTKV

SEQ ID NO: 8787 - protein, 9 aa, Homo sapiens
KMFAGVSSI

SEQ ID NO: 8788 - protein, 10 aa, Homo sapiens
KMMANGILKV

SEQ ID NO: 8789 - protein, 9 aa, Homo sapiens
KMMDLEHKV

SEQ ID NO: 8790 - protein, 9 aa, Homo sapiens
KMNEKLYTV

SEQ ID NO: 8791 - protein, 9 aa, Homo sapiens
KMPNGSAGV

SEQ ID NO: 8792 - protein, 9 aa, Homo sapiens
KMQASIEKA

SEQ ID NO: 8793 - protein, 9 aa, Homo sapiens
KMQESNHLL

SEQ ID NO: 8794 - protein, 9 aa, Homo sapiens
KMSEITKQL

SEQ ID NO: 8795 - protein, 10 aa, Homo sapiens
KMSVQPTVSL

SEQ ID NO: 8796 - protein, 9 aa, Homo sapiens
KMTDVESGV

SEQ ID NO: 8797 - protein, 11 aa, Homo sapiens
KMTEEEVEMLV

SEQ ID NO: 8798 - protein, 12 aa, Homo sapiens
KMVVIGAGVIGV

SEQ ID NO: 8799 - protein, 9 aa, Homo sapiens
KMWEKAIKL

SEQ ID NO: 8800 - protein, 11 aa, Homo sapiens
KQIVWNGPVGV

SEQ ID NO: 8801 - protein, 10 aa, Homo sapiens
KQMGFPLIYV

SEQ ID NO: 8802 - protein, 9 aa, Homo sapiens
KQQASQVLV

SEQ ID NO: 8803 - protein, 10 aa, Homo sapiens
KQQSELQSQV

SEQ ID NO: 8804 - protein, 9 aa, Homo sapiens
KQSNVQILV

SEQ ID NO: 8805 - protein, 9 aa, Homo sapiens
KQVSDLISV

SEQ ID NO: 8806 - protein, 9 aa, Homo sapiens
KTIETSPSL

SEQ ID NO: 8807 - protein, 9 aa, Homo sapiens
KTILTLTGV

SEQ ID NO: 8808 - protein, 11 aa, Homo sapiens
KVDNDENEHQL

SEQ ID NO: 8809 - protein, 9 aa, Homo sapiens
KVGDAIPAV

SEQ ID NO: 8810 - protein, 11 aa, Homo sapiens
KVLDVSDLESV

SEQ ID NO: 8811 - protein, 9 aa, Homo sapiens
KVLEFLAKV

SEQ ID NO: 8812 - protein, 9 aa, Homo sapiens
KVLETLVTV

SEQ ID NO: 8813 - protein, 11 aa, Homo sapiens
KVLEVTEEFGV

SEQ ID NO: 8814 - protein, 9 aa, Homo sapiens
KVNTPTTTV

SEQ ID NO: 8815 - protein, 9 aa, Homo sapiens
KVTKDGVTV

SEQ ID NO: 8816 - protein, 9 aa, Homo sapiens
KYTDWTEFL

SEQ ID NO: 8817 - protein, 9 aa, Homo sapiens
LAASALPAL

SEQ ID NO: 8818 - protein, 9 aa, Homo sapiens
LAGEIYVMV

SEQ ID NO: 8819 - protein, 9 aa, Homo sapiens
LAQANGWGV

SEQ ID NO: 8820 - protein, 9 aa, Homo sapiens
LFQPHLINV

SEQ ID NO: 8821 - protein, 11 aa, Homo sapiens
LFYADHPFIFL

SEQ ID NO: 8822 - protein, 8 aa, Homo sapiens
LIDHQTYL

SEQ ID NO: 8823 - protein, 12 aa, Homo sapiens
LIFDLGGGTFDV

SEQ ID NO: 8824 - protein, 9 aa, Homo sapiens
LIMELINNV

SEQ ID NO: 8825 - protein, 9 aa, Homo sapiens
LINVGLISV

SEQ ID NO: 8826 - protein, 8 aa, Homo sapiens
LLADAVAV

SEQ ID NO: 8827 - protein, 10 aa, Homo sapiens
LLAEGTITGV

SEQ ID NO: 8828 - protein, 9 aa, Homo sapiens
LLAKQPPTA

SEQ ID NO: 8829 - protein, 9 aa, Homo sapiens
LLASINSTV

SEQ ID NO: 8830 - protein, 10 aa, Homo sapiens
LLDAAGVASL

SEQ ID NO: 8831 - protein, 9 aa, Homo sapiens
LLDEQQVNV

SEQ ID NO: 8832 - protein, 9 aa, Homo sapiens
LLDGFPRTV

SEQ ID NO: 8833 - protein, 9 aa, Homo sapiens
LLDKVYSSV

SEQ ID NO: 8834 - protein, 9 aa, Homo sapiens
LLDLFSPSV

SEQ ID NO: 8835 - protein, 10 aa, Homo sapiens
LLDNEKPAAV

SEQ ID NO: 8836 - protein, 10 aa, Homo sapiens
LLDNFKPEEL

SEQ ID NO: 8837 - protein, 9 aa, Homo sapiens
LLDSVPPTA

SEQ ID NO: 8838 - protein, 9 aa, Homo sapiens
LLDTSRHYL

SEQ ID NO: 8839 - protein, 9 aa, Homo sapiens
LLDTWDQVF

SEQ ID NO: 8840 - protein, 8 aa, Homo sapiens
LLDVTPLS

SEQ ID NO: 8841 - protein, 9 aa, Homo sapiens
LLDVTPNAV

SEQ ID NO: 8842 - protein, 9 aa, Homo sapiens
LLDYHLNYL

SEQ ID NO: 8843 - protein, 10 aa, Homo sapiens
LLEGKVLPGV

SEQ ID NO: 8844 - protein, 9 aa, Homo sapiens
LLFGSIVAV

SEQ ID NO: 8845 - protein, 10 aa, Homo sapiens
LLFPHPVNQV

SEQ ID NO: 8846 - protein, 11 aa, Homo sapiens
LLFPPAEALQV

SEQ ID NO: 8847 - protein, 11 aa, Homo sapiens
LLGDALLVHPV

SEQ ID NO: 8848 - protein, 10 aa, Homo sapiens
LLGELPRLLL

SEQ ID NO: 8849 - protein, 11 aa, Homo sapiens
LLGELPRLLLL

SEQ ID NO: 8850 - protein, 9 aa, Homo sapiens
LLGKDVLFL

SEQ ID NO: 8851 - protein, 8 aa, Homo sapiens
LLGKVYVV

SEQ ID NO: 8852 - protein, 10 aa, Homo sapiens
LLGQFTLIGI

SEQ ID NO: 8853 - protein, 9 aa, Homo sapiens
LLGRIPSAV

SEQ ID NO: 8854 - protein, 9 aa, Homo sapiens
LLHEIENHL

SEQ ID NO: 8855 - protein, 11 aa, Homo sapiens
LLHESLFGSVA

SEQ ID NO: 8856 - protein, 12 aa, Homo sapiens
LLHSFEEFEALA

SEQ ID NO: 8857 - protein, 10 aa, Homo sapiens
LLLDVAPLSL

SEQ ID NO: 8858 - protein, 12 aa, Homo sapiens
LLLGERVALNTL

SEQ ID NO: 8859 - protein, 11 aa, Homo sapiens
LLLHLPALQSV

SEQ ID NO: 8860 - protein, 9 aa, Homo sapiens
LLLKNSPLV

SEQ ID NO: 8861 - protein, 9 aa, Homo sapiens
LLLPILVTV

SEQ ID NO: 8862 - protein, 9 aa, Homo sapiens
LLLPLNLEV

SEQ ID NO: 8863 - protein, 9 aa, Homo sapiens
LLLSGPPEV

SEQ ID NO: 8864 - protein, 9 aa, Homo sapiens
LLLSLLPAL

SEQ ID NO: 8865 - protein, 9 aa, Homo sapiens
LLMDSVIQA

SEQ ID NO: 8866 - protein, 9 aa, Homo sapiens
LLMGEQFLV

SEQ ID NO: 8867 - protein, 9 aa, Homo sapiens
LLMNIGPTL

SEQ ID NO: 8868 - protein, 10 aa, Homo sapiens
LLPEYGGTKV

SEQ ID NO: 8869 - protein, 9 aa, Homo sapiens
LLPHAAPFA

SEQ ID NO: 8870 - protein, 9 aa, Homo sapiens
LLPPPPPVA

SEQ ID NO: 8871 - protein, 9 aa, Homo sapiens
LLPPVTLAA

SEQ ID NO: 8872 - protein, 11 aa, Homo sapiens
LLPPVTLAALV

SEQ ID NO: 8873 - protein, 11 aa, Homo sapiens
LLQDFFDGRDL

SEQ ID NO: 8874 - protein, 11 aa, Homo sapiens
LLQDFFNGKEL

SEQ ID NO: 8875 - protein, 8 aa, Homo sapiens
LLQDGEFS

SEQ ID NO: 8876 - protein, 9 aa, Homo sapiens
LLQDGEFSM

SEQ ID NO: 8877 - protein, 9 aa, Homo sapiens
LLQEEVTKV

SEQ ID NO: 8878 - protein, 12 aa, Homo sapiens
LLQELEDLELGI

SEQ ID NO: 8879 - protein, 11 aa, Homo sapiens
LLQHTSEQEEM

SEQ ID NO: 8880 - protein, 9 aa, Homo sapiens
LLQKFVPEI

SEQ ID NO: 8881 - protein, 9 aa, Homo sapiens
LLQMITIHL

SEQ ID NO: 8882 - protein, 11 aa, Homo sapiens
LLSAEVARLLL

SEQ ID NO: 8883 - protein, 9 aa, Homo sapiens
LLSDPIPEV

SEQ ID NO: 8884 - protein, 9 aa, Homo sapiens
LLSDVFPGV

SEQ ID NO: 8885 - protein, 9 aa, Homo sapiens
LLSEADVRA

SEQ ID NO: 8886 - protein, 9 aa, Homo sapiens
LLSELAPSL

SEQ ID NO: 8887 - protein, 9 aa, Homo sapiens
LLSPLSVAT

SEQ ID NO: 8888 - protein, 9 aa, Homo sapiens
LLSPLVLEV

SEQ ID NO: 8889 - protein, 9 aa, Homo sapiens
LLSSVDQPL

SEQ ID NO: 8890 - protein, 12 aa, Homo sapiens
LLTDEEDVDMAL

SEQ ID NO: 8891 - protein, 11 aa, Homo sapiens
LLTEEEFLSFL

SEQ ID NO: 8892 - protein, 9 aa, Homo sapiens
LLTEMIHEA

SEQ ID NO: 8893 - protein, 9 aa, Homo sapiens
LLTTAEVVV

SEQ ID NO: 8894 - protein, 9 aa, Homo sapiens
LLTTQSPSV

SEQ ID NO: 8895 - protein, 9 aa, Homo sapiens
LLWAGSAGL

SEQ ID NO: 8896 - protein, 12 aa, Homo sapiens
LLWALEPEKPLV

SEQ ID NO: 8897 - protein, 9 aa, Homo sapiens
LLYDRSWMV

SEQ ID NO: 8898 - protein, 9 aa, Homo sapiens
LLYGKYVSV

SEQ ID NO: 8899 - protein, 9 aa, Homo sapiens
LLYPTEITV

SEQ ID NO: 8900 - protein, 8 aa, Homo sapiens
LLYSFPVV

SEQ ID NO: 8901 - protein, 9 aa, Homo sapiens
LLYSFPVVI

SEQ ID NO: 8902 - protein, 9 aa, Homo sapiens
LMADVHFVV

SEQ ID NO: 8903 - protein, 9 aa, Homo sapiens
LMAEEVQAV

SEQ ID NO: 8904 - protein, 9 aa, Homo sapiens
LMKLSHETV

SEQ ID NO: 8905 - protein, 11 aa, Homo sapiens
LMNGSESRFFV

SEQ ID NO: 8906 - protein, 9 aa, Homo sapiens
LMNPNIASV

SEQ ID NO: 8907 - protein, 8 aa, Homo sapiens
LMTTVHAI

SEQ ID NO: 8908 - protein, 10 aa, Homo sapiens
LMTTVHAITA

SEQ ID NO: 8909 - protein, 8 aa, Homo sapiens
LQEMVHQV

SEQ ID NO: 8910 - protein, 10 aa, Homo sapiens
LTIDDGIFEV

SEQ ID NO: 8911 - protein, 11 aa, Homo sapiens
LTNDWEDHLAV

SEQ ID NO: 8912 - protein, 9 aa, Homo sapiens
LTPDNVANL

SEQ ID NO: 8913 - protein, 11 aa, Homo sapiens
LVEDFLSGFQV

SEQ ID NO: 8914 - protein, 12 aa, Homo sapiens
LVFDLGGGTFDV

SEQ ID NO: 8915 - protein, 9 aa, Homo sapiens
LVGTVTKPV

SEQ ID NO: 8916 - protein, 11 aa, Homo sapiens
LVLEVDPNIQA

SEQ ID NO: 8917 - protein, 12 aa, Homo sapiens
LVLEVDPNIQAV

SEQ ID NO: 8918 - protein, 10 aa, Homo sapiens
MLAEKLPNLT

SEQ ID NO: 8919 - protein, 12 aa, Homo sapiens
MLAEKLPNLTHL

SEQ ID NO: 8920 - protein, 9 aa, Homo sapiens
MLAEVNATI

SEQ ID NO: 8921 - protein, 11 aa, Homo sapiens
MLANDIARLMV

SEQ ID NO: 8922 - protein, 11 aa, Homo sapiens
MLAVDAVIAEL

SEQ ID NO: 8923 - protein, 9 aa, Homo sapiens
MLDEPTNHL

SEQ ID NO: 8924 - protein, 10 aa, Homo sapiens
MLDNLLDIEV

SEQ ID NO: 8925 - protein, 12 aa, Homo sapiens
MLKEWEKFQEEA

SEQ ID NO: 8926 - protein, 10 aa, Homo sapiens
MLLDTWDQVF

SEQ ID NO: 8927 - protein, 10 aa, Homo sapiens
MLLGASLVGV

SEQ ID NO: 8928 - protein, 11 aa, Homo sapiens
MLMGFKPLVLL

SEQ ID NO: 8929 - protein, 9 aa, Homo sapiens
MLQDFQIQA

SEQ ID NO: 8930 - protein, 11 aa, Homo sapiens
MLQGVDLLADA

SEQ ID NO: 8931 - protein, 9 aa, Homo sapiens
MLSEVLQYI

SEQ ID NO: 8932 - protein, 11 aa, Homo sapiens
MLVSGAGDIKL

SEQ ID NO: 8933 - protein, 11 aa, Homo sapiens
MLWGSDPYPHA

SEQ ID NO: 8934 - protein, 9 aa, Homo sapiens
MLYEGFYDV

SEQ ID NO: 8935 - protein, 11 aa, Homo sapiens
MLYGRIGYIYA

SEQ ID NO: 8936 - protein, 11 aa, Homo sapiens
MMDLQHGSLFL

SEQ ID NO: 8937 - protein, 8 aa, Homo sapiens
MMDVDHQI

SEQ ID NO: 8938 - protein, 9 aa, Homo sapiens
MMVGDLLEV

SEQ ID NO: 8939 - protein, 11 aa, Homo sapiens
MTADAAKRLNV

SEQ ID NO: 8940 - protein, 9 aa, Homo sapiens
MTLGQIYYL

SEQ ID NO: 8941 - protein, 11 aa, Homo sapiens
NIGDLASILKV

SEQ ID NO: 8942 - protein, 10 aa, Homo sapiens
NIMDIKIGLL

SEQ ID NO: 8943 - protein, 11 aa, Homo sapiens
NIMDIKIGLLV

SEQ ID NO: 8944 - protein, 9 aa, Homo sapiens
NISPFSFGL

SEQ ID NO: 8945 - protein, 9 aa, Homo sapiens
NLAAYVPLL

SEQ ID NO: 8946 - protein, 9 aa, Homo sapiens
NLAEELEGV

SEQ ID NO: 8947 - protein, 10 aa, Homo sapiens
NLEFLSLINV

SEQ ID NO: 8948 - protein, 12 aa, Homo sapiens
NLFDISTEEGST

SEQ ID NO: 8949 - protein, 12 aa, Homo sapiens
NLFGRGMDIERV

SEQ ID NO: 8950 - protein, 12 aa, Homo sapiens
NLFPGLKEAFVV

SEQ ID NO: 8951 - protein, 9 aa, Homo sapiens
NLISLLEVL

SEQ ID NO: 8952 - protein, 10 aa, Homo sapiens
NLKAAQEEYV

SEQ ID NO: 8953 - protein, 11 aa, Homo sapiens
NLLDLLLIHEV

SEQ ID NO: 8954 - protein, 9 aa, Homo sapiens
NLLDLLTEV

SEQ ID NO: 8955 - protein, 11 aa, Homo sapiens
NLLDLLTEVGV

SEQ ID NO: 8956 - protein, 10 aa, Homo sapiens
NLMDIKIGLL

SEQ ID NO: 8957 - protein, 11 aa, Homo sapiens
NLMDIKIGLLV

SEQ ID NO: 8958 - protein, 11 aa, Homo sapiens
NLPAPHIMPGV

SEQ ID NO: 8959 - protein, 11 aa, Homo sapiens
NLWGGQGLLGV

SEQ ID NO: 8960 - protein, 10 aa, Homo sapiens
NLYGSHPFYL

SEQ ID NO: 8961 - protein, 10 aa, Homo sapiens
NLYSDDIPHA

SEQ ID NO: 8962 - protein, 11 aa, Homo sapiens
NTAVVPQGWSV

SEQ ID NO: 8963 - protein, 11 aa, Homo sapiens
PLDPGGHLHLL

SEQ ID NO: 8964 - protein, 11 aa, Homo sapiens
PLMSEDELINI

SEQ ID NO: 8965 - protein, 9 aa, Homo sapiens
QFINFPIYV

SEQ ID NO: 8966 - protein, 10 aa, Homo sapiens
QLADLYKSFI

SEQ ID NO: 8967 - protein, 9 aa, Homo sapiens
QLAEMLPGV

SEQ ID NO: 8968 - protein, 10 aa, Homo sapiens
QLEEEGITFV

SEQ ID NO: 8969 - protein, 12 aa, Homo sapiens
QLFDDESDPFEV

SEQ ID NO: 8970 - protein, 9 aa, Homo sapiens
QLFEDLVYL

SEQ ID NO: 8971 - protein, 9 aa, Homo sapiens
QLISKIPHI

SEQ ID NO: 8972 - protein, 11 aa, Homo sapiens
QLLAERSLAPT

SEQ ID NO: 8973 - protein, 9 aa, Homo sapiens
QLLDNPARV

SEQ ID NO: 8974 - protein, 9 aa, Homo sapiens
QLLGSAHEV

SEQ ID NO: 8975 - protein, 9 aa, Homo sapiens
QLLPLVFEV

SEQ ID NO: 8976 - protein, 11 aa, Homo sapiens
QLMHNIRDIDV

SEQ ID NO: 8977 - protein, 9 aa, Homo sapiens
QLMSLIINT

SEQ ID NO: 8978 - protein, 9 aa, Homo sapiens
QLNADEISL

SEQ ID NO: 8979 - protein, 9 aa, Homo sapiens
QLQDFYQEV

SEQ ID NO: 8980 - protein, 9 aa, Homo sapiens
QLSEIQTQI

SEQ ID NO: 8981 - protein, 9 aa, Homo sapiens
QLWNGIISI

SEQ ID NO: 8982 - protein, 8 aa, Homo sapiens
QLYPISIF

SEQ ID NO: 8983 - protein, 9 aa, Homo sapiens
QLYPISIFI

SEQ ID NO: 8984 - protein, 9 aa, Homo sapiens
QMFEGVARV

SEQ ID NO: 8985 - protein, 9 aa, Homo sapiens
QVAELELQL

SEQ ID NO: 8986 - protein, 12 aa, Homo sapiens
QVWDYEEGEVEA

SEQ ID NO: 8987 - protein, 9 aa, Homo sapiens
RILSKLHTV

SEQ ID NO: 8988 - protein, 9 aa, Homo sapiens
RIMEKIRNV

SEQ ID NO: 8989 - protein, 9 aa, Homo sapiens
RLADKSVLV

SEQ ID NO: 8990 - protein, 9 aa, Homo sapiens
RLAEAHAKV

SEQ ID NO: 8991 - protein, 9 aa, Homo sapiens
RLAKYNQLL

SEQ ID NO: 8992 - protein, 12 aa, Homo sapiens
RLAPALALPAPA

SEQ ID NO: 8993 - protein, 10 aa, Homo sapiens
RLATYGITVA

SEQ ID NO: 8994 - protein, 8 aa, Homo sapiens
RLDDFFKV

SEQ ID NO: 8995 - protein, 9 aa, Homo sapiens
RLDFNLIRV

SEQ ID NO: 8996 - protein, 9 aa, Homo sapiens
RLDTHPAMV

SEQ ID NO: 8997 - protein, 9 aa, Homo sapiens
RLFPGRVSV

SEQ ID NO: 8998 - protein, 9 aa, Homo sapiens
RLFSMAHTV

SEQ ID NO: 8999 - protein, 9 aa, Homo sapiens
RLHDNVHAV

SEQ ID NO: 9000 - protein, 10 aa, Homo sapiens
RLIDHLHNCP

SEQ ID NO: 9001 - protein, 11 aa, Homo sapiens
RLIGDAAKNQL

SEQ ID NO: 9002 - protein, 9 aa, Homo sapiens
RLIKAYEKV

SEQ ID NO: 9003 - protein, 10 aa, Homo sapiens
RLLDTKNPSL

SEQ ID NO: 9004 - protein, 11 aa, Homo sapiens
RLLPSIGLSTV

SEQ ID NO: 9005 - protein, 9 aa, Homo sapiens
RLMEPIYLV

SEQ ID NO: 9006 - protein, 9 aa, Homo sapiens
RLQAFDFLL

SEQ ID NO: 9007 - protein, 8 aa, Homo sapiens
RLYDGLFK

SEQ ID NO: 9008 - protein, 10 aa, Homo sapiens
RLYQSNLVLV

SEQ ID NO: 9009 - protein, 9 aa, Homo sapiens
RMGPPLHTV

SEQ ID NO: 9010 - protein, 11 aa, Homo sapiens
RMLDMGFEPQI

SEQ ID NO: 9011 - protein, 9 aa, Homo sapiens
RQADKVWRL

SEQ ID NO: 9012 - protein, 9 aa, Homo sapiens
RQDENTPSV

SEQ ID NO: 9013 - protein, 9 aa, Homo sapiens
RQHEIVLKV

SEQ ID NO: 9014 - protein, 10 aa, Homo sapiens
RQLDMELVSV

SEQ ID NO: 9015 - protein, 9 aa, Homo sapiens
RQVEKAWAL

SEQ ID NO: 9016 - protein, 11 aa, Homo sapiens
RVDPNGSRYLL

SEQ ID NO: 9017 - protein, 12 aa, Homo sapiens
RVFSSSQGVEQV

SEQ ID NO: 9018 - protein, 9 aa, Homo sapiens
RVIISAPSA

SEQ ID NO: 9019 - protein, 11 aa, Homo sapiens
RVLANPGNSQV

SEQ ID NO: 9020 - protein, 12 aa, Homo sapiens
RVLSIGDGIARV

SEQ ID NO: 9021 - protein, 9 aa, Homo sapiens
RVPTANVSV

SEQ ID NO: 9022 - protein, 9 aa, Homo sapiens
SASLLWNFI

SEQ ID NO: 9023 - protein, 9 aa, Homo sapiens
SIADLLPAL

SEQ ID NO: 9024 - protein, 10 aa, Homo sapiens
SIDIPSGWDV

SEQ ID NO: 9025 - protein, 12 aa, Homo sapiens
SIFDGFADGLGV

SEQ ID NO: 9026 - protein, 10 aa, Homo sapiens
SIFGLAPSKA

SEQ ID NO: 9027 - protein, 10 aa, Homo sapiens
SIFGLGLAYA

SEQ ID NO: 9028 - protein, 11 aa, Homo sapiens
SIGEPTVPSTL

SEQ ID NO: 9029 - protein, 9 aa, Homo sapiens
SIHKFVPYL

SEQ ID NO: 9030 - protein, 11 aa, Homo sapiens
SIIDFYPEDFA

SEQ ID NO: 9031 - protein, 11 aa, Homo sapiens
SIIMLEALERV

SEQ ID NO: 9032 - protein, 12 aa, Homo sapiens
SILTIDDGIFEV

SEQ ID NO: 9033 - protein, 12 aa, Homo sapiens
SILTIEDGIFEV

SEQ ID NO: 9034 - protein, 10 aa, Homo sapiens
SIMGIGPIPA

SEQ ID NO: 9035 - protein, 9 aa, Homo sapiens
SIQSIVPAL

SEQ ID NO: 9036 - protein, 11 aa, Homo sapiens
SIQSIVPALEI

SEQ ID NO: 9037 - protein, 9 aa, Homo sapiens
SISSTPPAV

SEQ ID NO: 9038 - protein, 9 aa, Homo sapiens
SIYQFLIAV

SEQ ID NO: 9039 - protein, 9 aa, Homo sapiens
SLAAFLPDL

SEQ ID NO: 9040 - protein, 12 aa, Homo sapiens
SLAAFLPDLSLA

SEQ ID NO: 9041 - protein, 9 aa, Homo sapiens
SLAANTFTI

SEQ ID NO: 9042 - protein, 9 aa, Homo sapiens
SLAAPTWLV

SEQ ID NO: 9043 - protein, 10 aa, Homo sapiens
SLAAVSGTAA

SEQ ID NO: 9044 - protein, 9 aa, Homo sapiens
SLADELALV

SEQ ID NO: 9045 - protein, 11 aa, Homo sapiens
SLADELALVDV

SEQ ID NO: 9046 - protein, 12 aa, Homo sapiens
SLADELALVDVL

SEQ ID NO: 9047 - protein, 9 aa, Homo sapiens
SLADLMPRV

SEQ ID NO: 9048 - protein, 12 aa, Homo sapiens
SLADLQNDEVAF

SEQ ID NO: 9049 - protein, 10 aa, Homo sapiens
SLADVIIHEI

SEQ ID NO: 9050 - protein, 9 aa, Homo sapiens
SLAEKVIPA

SEQ ID NO: 9051 - protein, 9 aa, Homo sapiens
SLAELPAIM

SEQ ID NO: 9052 - protein, 9 aa, Homo sapiens
SLAEVNTQI

SEQ ID NO: 9053 - protein, 10 aa, Homo sapiens
SLAGSSGPGA

SEQ ID NO: 9054 - protein, 10 aa, Homo sapiens
SLAPAGVIRV

SEQ ID NO: 9055 - protein, 9 aa, Homo sapiens
SLAPIIVFV

SEQ ID NO: 9056 - protein, 9 aa, Homo sapiens
SLAPIIVYV

SEQ ID NO: 9057 - protein, 9 aa, Homo sapiens
SLAPQIKVI

SEQ ID NO: 9058 - protein, 10 aa, Homo sapiens
SLASLPPLHV

SEQ ID NO: 9059 - protein, 9 aa, Homo sapiens
SLASVIFLL

SEQ ID NO: 9060 - protein, 11 aa, Homo sapiens
SLAVDPNGIYL

SEQ ID NO: 9061 - protein, 9 aa, Homo sapiens
SLDDFQAWL

SEQ ID NO: 9062 - protein, 9 aa, Homo sapiens
SLDDLLTNV

SEQ ID NO: 9063 - protein, 12 aa, Homo sapiens
SLDDSVDETEAV

SEQ ID NO: 9064 - protein, 9 aa, Homo sapiens
SLDDTELRL

SEQ ID NO: 9065 - protein, 10 aa, Homo sapiens
SLDDVEGMSV

SEQ ID NO: 9066 - protein, 10 aa, Homo sapiens
SLDEDSEFTL

SEQ ID NO: 9067 - protein, 11 aa, Homo sapiens
SLDEDSEFTLA

SEQ ID NO: 9068 - protein, 9 aa, Homo sapiens
SLDEELDRV

SEQ ID NO: 9069 - protein, 11 aa, Homo sapiens
SLDEIEQVILV

SEQ ID NO: 9070 - protein, 11 aa, Homo sapiens
SLDESTQESKL

SEQ ID NO: 9071 - protein, 9 aa, Homo sapiens
SLDGAPIGV

SEQ ID NO: 9072 - protein, 9 aa, Homo sapiens
SLDGIPFTV

SEQ ID NO: 9073 - protein, 9 aa, Homo sapiens
SLDGKAIKV

SEQ ID NO: 9074 - protein, 12 aa, Homo sapiens
SLDKFLASVSTV

SEQ ID NO: 9075 - protein, 9 aa, Homo sapiens
SLDKTSPEM

SEQ ID NO: 9076 - protein, 11 aa, Homo sapiens
SLDLDGIIAEV

SEQ ID NO: 9077 - protein, 9 aa, Homo sapiens
SLDLFNCEV

SEQ ID NO: 9078 - protein, 9 aa, Homo sapiens
SLDLSSPNM

SEQ ID NO: 9079 - protein, 11 aa, Homo sapiens
SLDMDSIIAEV

SEQ ID NO: 9080 - protein, 9 aa, Homo sapiens
SLDNLKASV

SEQ ID NO: 9081 - protein, 9 aa, Homo sapiens
SLDPHAQVA

SEQ ID NO: 9082 - protein, 11 aa, Homo sapiens
SLDPTAGSLSV

SEQ ID NO: 9083 - protein, 9 aa, Homo sapiens
SLDQLELRV

SEQ ID NO: 9084 - protein, 9 aa, Homo sapiens
SLDQSVTHL

SEQ ID NO: 9085 - protein, 10 aa, Homo sapiens
SLDSLGDVFL

SEQ ID NO: 9086 - protein, 9 aa, Homo sapiens
SLDSSNASV

SEQ ID NO: 9087 - protein, 11 aa, Homo sapiens
SLEELPVDIIL

SEQ ID NO: 9088 - protein, 12 aa, Homo sapiens
SLEELPVDIILA

SEQ ID NO: 9089 - protein, 10 aa, Homo sapiens
SLFDEEGAKI

SEQ ID NO: 9090 - protein, 12 aa, Homo sapiens
SLFEEDKEDDLF

SEQ ID NO: 9091 - protein, 8 aa, Homo sapiens
SLFEEMLQ

SEQ ID NO: 9092 - protein, 9 aa, Homo sapiens
SLFEGIDFY

SEQ ID NO: 9093 - protein, 10 aa, Homo sapiens
SLFEGIDFYT

SEQ ID NO: 9094 - protein, 11 aa, Homo sapiens
SLFEGIDFYTS

SEQ ID NO: 9095 - protein, 10 aa, Homo sapiens
SLFEGTWYLV

SEQ ID NO: 9096 - protein, 9 aa, Homo sapiens
SLFEHFIEL

SEQ ID NO: 9097 - protein, 12 aa, Homo sapiens
SLFESLISPIKT

SEQ ID NO: 9098 - protein, 9 aa, Homo sapiens
SLFEWFHPL

SEQ ID NO: 9099 - protein, 10 aa, Homo sapiens
SLFEWFHPLF

SEQ ID NO: 9100 - protein, 11 aa, Homo sapiens
SLFEWFHPLFL

SEQ ID NO: 9101 - protein, 9 aa, Homo sapiens
SLFGFSFNA

SEQ ID NO: 9102 - protein, 11 aa, Homo sapiens
SLFGFSFNAPL

SEQ ID NO: 9103 - protein, 9 aa, Homo sapiens
SLFGGKPMI

SEQ ID NO: 9104 - protein, 10 aa, Homo sapiens
SLFGGKPMII

SEQ ID NO: 9105 - protein, 10 aa, Homo sapiens
SLFGGSVKLA

SEQ ID NO: 9106 - protein, 9 aa, Homo sapiens
SLFGKDIKV

SEQ ID NO: 9107 - protein, 12 aa, Homo sapiens
SLFGSVADDQKL

SEQ ID NO: 9108 - protein, 9 aa, Homo sapiens
SLFGYSVAL

SEQ ID NO: 9109 - protein, 12 aa, Homo sapiens
SLFKHDPAAWEA

SEQ ID NO: 9110 - protein, 12 aa, Homo sapiens
SLFLFDGSPTYV

SEQ ID NO: 9111 - protein, 11 aa, Homo sapiens
SLFLGQKLQVV

SEQ ID NO: 9112 - protein, 9 aa, Homo sapiens
SLFLQTPKI

SEQ ID NO: 9113 - protein, 12 aa, Homo sapiens
SLFLWVGATPHL

SEQ ID NO: 9114 - protein, 11 aa, Homo sapiens
SLFQAMQKGLV

SEQ ID NO: 9115 - protein, 12 aa, Homo sapiens
SLFQAMQKGLVL

SEQ ID NO: 9116 - protein, 9 aa, Homo sapiens
SLFSDEFKV

SEQ ID NO: 9117 - protein, 11 aa, Homo sapiens
SLFSDEFKVET

SEQ ID NO: 9118 - protein, 9 aa, Homo sapiens
SLFSEETPV

SEQ ID NO: 9119 - protein, 10 aa, Homo sapiens
SLFSEETPVV

SEQ ID NO: 9120 - protein, 10 aa, Homo sapiens
SLFTKELEHA

SEQ ID NO: 9121 - protein, 9 aa, Homo sapiens
SLGDAFPEL

SEQ ID NO: 9122 - protein, 10 aa, Homo sapiens
SLGDFIEHYA

SEQ ID NO: 9123 - protein, 10 aa, Homo sapiens
SLGEEIQESL

SEQ ID NO: 9124 - protein, 9 aa, Homo sapiens
SLGELIGTL

SEQ ID NO: 9125 - protein, 11 aa, Homo sapiens
SLGELIGTLNA

SEQ ID NO: 9126 - protein, 9 aa, Homo sapiens
SLGETQLVL

SEQ ID NO: 9127 - protein, 11 aa, Homo sapiens
SLGEVGHHIDL

SEQ ID NO: 9128 - protein, 11 aa, Homo sapiens
SLGGFEITPPV

SEQ ID NO: 9129 - protein, 12 aa, Homo sapiens
SLGGFEITPPVV

SEQ ID NO: 9130 - protein, 9 aa, Homo sapiens
SLGLPFGKV

SEQ ID NO: 9131 - protein, 9 aa, Homo sapiens
SLGPHPIPV

SEQ ID NO: 9132 - protein, 9 aa, Homo sapiens
SLGTRPPHV

SEQ ID NO: 9133 - protein, 9 aa, Homo sapiens
SLHDALCVV

SEQ ID NO: 9134 - protein, 9 aa, Homo sapiens
SLIDFLRVV

SEQ ID NO: 9135 - protein, 9 aa, Homo sapiens
SLIEESEEL

SEQ ID NO: 9136 - protein, 11 aa, Homo sapiens
SLINQIENLNI

SEQ ID NO: 9137 - protein, 11 aa, Homo sapiens
SLINVGLISVS

SEQ ID NO: 9138 - protein, 9 aa, Homo sapiens
SLIPDIKPL

SEQ ID NO: 9139 - protein, 10 aa, Homo sapiens
SLIPDIKPLA

SEQ ID NO: 9140 - protein, 9 aa, Homo sapiens
SLISSRIYV

SEQ ID NO: 9141 - protein, 11 aa, Homo sapiens
SLKDGLIPLEI

SEQ ID NO: 9142 - protein, 9 aa, Homo sapiens
SLKTFVHTV

SEQ ID NO: 9143 - protein, 10 aa, Homo sapiens
SLLAGKGFAV

SEQ ID NO: 9144 - protein, 8 aa, Homo sapiens
SLLAWTLL

SEQ ID NO: 9145 - protein, 11 aa, Homo sapiens
SLLDDQDGISL

SEQ ID NO: 9146 - protein, 9 aa, Homo sapiens
SLLDGHFVL

SEQ ID NO: 9147 - protein, 9 aa, Homo sapiens
SLLDIDPLI

SEQ ID NO: 9148 - protein, 11 aa, Homo sapiens
SLLDLLLPTGL

SEQ ID NO: 9149 - protein, 9 aa, Homo sapiens
SLLDNMIGV

SEQ ID NO: 9150 - protein, 11 aa, Homo sapiens
SLLDSDNFIGL

SEQ ID NO: 9151 - protein, 9 aa, Homo sapiens
SLLDSVVGL

SEQ ID NO: 9152 - protein, 9 aa, Homo sapiens
SLLDTLSPA

SEQ ID NO: 9153 - protein, 10 aa, Homo sapiens
SLLEEFDFHV

SEQ ID NO: 9154 - protein, 9 aa, Homo sapiens
SLLEFNTTV

SEQ ID NO: 9155 - protein, 11 aa, Homo sapiens
SLLEVLSGDSL

SEQ ID NO: 9156 - protein, 11 aa, Homo sapiens
SLLEVNEESTV

SEQ ID NO: 9157 - protein, 9 aa, Homo sapiens
SLLGATVTV

SEQ ID NO: 9158 - protein, 11 aa, Homo sapiens
SLLGGNIRLLL

SEQ ID NO: 9159 - protein, 8 aa, Homo sapiens
SLLGHLMI

SEQ ID NO: 9160 - protein, 10 aa, Homo sapiens
SLLGHLMIVG

SEQ ID NO: 9161 - protein, 9 aa, Homo sapiens
SLLGKDVLF

SEQ ID NO: 9162 - protein, 10 aa, Homo sapiens
SLLGKDVLFL

SEQ ID NO: 9163 - protein, 9 aa, Homo sapiens
SLLIDVITV

SEQ ID NO: 9164 - protein, 8 aa, Homo sapiens
SLLPFWYT

SEQ ID NO: 9165 - protein, 9 aa, Homo sapiens
SLLPFWYTL

SEQ ID NO: 9166 - protein, 11 aa, Homo sapiens
SLLPGKLPTLV

SEQ ID NO: 9167 - protein, 11 aa, Homo sapiens
SLLPGKLPTSV

SEQ ID NO: 9168 - protein, 9 aa, Homo sapiens
SLLPKLHIV

SEQ ID NO: 9169 - protein, 12 aa, Homo sapiens
SLLQDGEFSMDL

SEQ ID NO: 9170 - protein, 10 aa, Homo sapiens
SLLSDPIPEV

SEQ ID NO: 9171 - protein, 10 aa, Homo sapiens
SLLSEADVRA

SEQ ID NO: 9172 - protein, 11 aa, Homo sapiens
SLLSEADVRAL

SEQ ID NO: 9173 - protein, 9 aa, Homo sapiens
SLLSNLDEV

SEQ ID NO: 9174 - protein, 9 aa, Homo sapiens
SLLTHNENM

SEQ ID NO: 9175 - protein, 11 aa, Homo sapiens
SLLTHNENMVA

SEQ ID NO: 9176 - protein, 12 aa, Homo sapiens
SLLTIDNGVFEV

SEQ ID NO: 9177 - protein, 12 aa, Homo sapiens
SLLTIQEVDEFL

SEQ ID NO: 9178 - protein, 10 aa, Homo sapiens
SLLTTAEVVV

SEQ ID NO: 9179 - protein, 9 aa, Homo sapiens
SLMADLEGL

SEQ ID NO: 9180 - protein, 11 aa, Homo sapiens
SLMADLEGLHL

SEQ ID NO: 9181 - protein, 10 aa, Homo sapiens
SLMDDYLGLV

SEQ ID NO: 9182 - protein, 10 aa, Homo sapiens
SLMDGLGAKV

SEQ ID NO: 9183 - protein, 11 aa, Homo sapiens
SLMDPNKFLLL

SEQ ID NO: 9184 - protein, 11 aa, Homo sapiens
SLMEQVSGVEA

SEQ ID NO: 9185 - protein, 11 aa, Homo sapiens
SLMETGWFDNL

SEQ ID NO: 9186 - protein, 12 aa, Homo sapiens
SLMETGWFDNLL

SEQ ID NO: 9187 - protein, 10 aa, Homo sapiens
SLMGIKMTTV

SEQ ID NO: 9188 - protein, 9 aa, Homo sapiens
SLMHTIYEV

SEQ ID NO: 9189 - protein, 9 aa, Homo sapiens
SLMIDLIEV

SEQ ID NO: 9190 - protein, 9 aa, Homo sapiens
SLMLVTVEL

SEQ ID NO: 9191 - protein, 9 aa, Homo sapiens
SLMNIQHFL

SEQ ID NO: 9192 - protein, 11 aa, Homo sapiens
SLMPYFLLTQA

SEQ ID NO: 9193 - protein, 10 aa, Homo sapiens
SLMTKEISSV

SEQ ID NO: 9194 - protein, 11 aa, Homo sapiens
SLNDLEKDVML

SEQ ID NO: 9195 - protein, 11 aa, Homo sapiens
SLNEFGEKWEL

SEQ ID NO: 9196 - protein, 9 aa, Homo sapiens
SLNFVSTLL

SEQ ID NO: 9197 - protein, 9 aa, Homo sapiens
SLNKYIEEM

SEQ ID NO: 9198 - protein, 9 aa, Homo sapiens
SLNTDQTTA

SEQ ID NO: 9199 - protein, 9 aa, Homo sapiens
SLPKGVVEV

SEQ ID NO: 9200 - protein, 12 aa, Homo sapiens
SLPLSVGQPASI

SEQ ID NO: 9201 - protein, 10 aa, Homo sapiens
SLQACKLAQA

SEQ ID NO: 9202 - protein, 11 aa, Homo sapiens
SLQDIGMDHQA

SEQ ID NO: 9203 - protein, 12 aa, Homo sapiens
SLQDIGMDHQAL

SEQ ID NO: 9204 - protein, 9 aa, Homo sapiens
SLQDIIAIL

SEQ ID NO: 9205 - protein, 8 aa, Homo sapiens
SLQEEIAF

SEQ ID NO: 9206 - protein, 9 aa, Homo sapiens
SLQEELSLA

SEQ ID NO: 9207 - protein, 9 aa, Homo sapiens
SLQEFINWL

SEQ ID NO: 9208 - protein, 11 aa, Homo sapiens
SLQELFLAHIL

SEQ ID NO: 9209 - protein, 9 aa, Homo sapiens
SLQELNPEM

SEQ ID NO: 9210 - protein, 9 aa, Homo sapiens
SLQENLESL

SEQ ID NO: 9211 - protein, 10 aa, Homo sapiens
SLQESILAQV

SEQ ID NO: 9212 - protein, 9 aa, Homo sapiens
SLQMYLERL

SEQ ID NO: 9213 - protein, 9 aa, Homo sapiens
SLQNGVTAA

SEQ ID NO: 9214 - protein, 11 aa, Homo sapiens
SLQPLPVILHV

SEQ ID NO: 9215 - protein, 10 aa, Homo sapiens
SLQSGSIPLA

SEQ ID NO: 9216 - protein, 9 aa, Homo sapiens
SLQSLETSV

SEQ ID NO: 9217 - protein, 11 aa, Homo sapiens
SLRVEGDNIYV

SEQ ID NO: 9218 - protein, 10 aa, Homo sapiens
SLSALIGEAV

SEQ ID NO: 9219 - protein, 9 aa, Homo sapiens
SLSDVSTFL

SEQ ID NO: 9220 - protein, 11 aa, Homo sapiens
SLSESEYIEEV

SEQ ID NO: 9221 - protein, 9 aa, Homo sapiens
SLSFLVPSL

SEQ ID NO: 9222 - protein, 9 aa, Homo sapiens
SLSGPPEKV

SEQ ID NO: 9223 - protein, 10 aa, Homo sapiens
SLSKLGDVYV

SEQ ID NO: 9224 - protein, 9 aa, Homo sapiens
SLSMVNHRL

SEQ ID NO: 9225 - protein, 9 aa, Homo sapiens
SLSNESNKV

SEQ ID NO: 9226 - protein, 12 aa, Homo sapiens
SLSNLQVTQPTV

SEQ ID NO: 9227 - protein, 9 aa, Homo sapiens
SLSRVNTTL

SEQ ID NO: 9228 - protein, 11 aa, Homo sapiens
SLSTAAGAAEL

SEQ ID NO: 9229 - protein, 9 aa, Homo sapiens
SLTEYLQNV

SEQ ID NO: 9230 - protein, 11 aa, Homo sapiens
SLTNDWEDHLA

SEQ ID NO: 9231 - protein, 12 aa, Homo sapiens
SLTNDWEDHLAV

SEQ ID NO: 9232 - protein, 9 aa, Homo sapiens
SLTSKIPAL

SEQ ID NO: 9233 - protein, 11 aa, Homo sapiens
SLTSKIPALAV

SEQ ID NO: 9234 - protein, 9 aa, Homo sapiens
SLTSQPHQV

SEQ ID NO: 9235 - protein, 11 aa, Homo sapiens
SLVEVNPAYSV

SEQ ID NO: 9236 - protein, 11 aa, Homo sapiens
SLVGKDVVVEL

SEQ ID NO: 9237 - protein, 11 aa, Homo sapiens
SLVSPASFENV

SEQ ID NO: 9238 - protein, 12 aa, Homo sapiens
SLYDEVAAQGEV

SEQ ID NO: 9239 - protein, 12 aa, Homo sapiens
SLYDILARGASV

SEQ ID NO: 9240 - protein, 11 aa, Homo sapiens
SLYEGIDFYTS

SEQ ID NO: 9241 - protein, 12 aa, Homo sapiens
SLYEGIDFYTSI

SEQ ID NO: 9242 - protein, 9 aa, Homo sapiens
SLYGGNAVV

SEQ ID NO: 9243 - protein, 11 aa, Homo sapiens
SLYGGNAVVEL

SEQ ID NO: 9244 - protein, 12 aa, Homo sapiens
SLYGGNAVVELV

SEQ ID NO: 9245 - protein, 8 aa, Homo sapiens
SLYGGTIT

SEQ ID NO: 9246 - protein, 9 aa, Homo sapiens
SLYIKDIWL

SEQ ID NO: 9247 - protein, 10 aa, Homo sapiens
SLYKNKEIFL

SEQ ID NO: 9248 - protein, 10 aa, Homo sapiens
SLYNEELVSM

SEQ ID NO: 9249 - protein, 12 aa, Homo sapiens
SLYNEELVSMNV

SEQ ID NO: 9250 - protein, 9 aa, Homo sapiens
SLYPIAVLI

SEQ ID NO: 9251 - protein, 9 aa, Homo sapiens
SLYPLTFIQ

SEQ ID NO: 9252 - protein, 10 aa, Homo sapiens
SLYPLTFIQV

SEQ ID NO: 9253 - protein, 11 aa, Homo sapiens
SLYPSLEDLKV

SEQ ID NO: 9254 - protein, 10 aa, Homo sapiens
SLYRPALEEL

SEQ ID NO: 9255 - protein, 10 aa, Homo sapiens
SLYSEKEVFI

SEQ ID NO: 9256 - protein, 9 aa, Homo sapiens
SLYTILTYI

SEQ ID NO: 9257 - protein, 9 aa, Homo sapiens
SMAEVDAAM

SEQ ID NO: 9258 - protein, 9 aa, Homo sapiens
SMDENLMHI

SEQ ID NO: 9259 - protein, 9 aa, Homo sapiens
SMDEYVHQI

SEQ ID NO: 9260 - protein, 9 aa, Homo sapiens
SMDNFNWGV

SEQ ID NO: 9261 - protein, 9 aa, Homo sapiens
SMGGKVPPA

SEQ ID NO: 9262 - protein, 9 aa, Homo sapiens
SMIFSIPYI

SEQ ID NO: 9263 - protein, 12 aa, Homo sapiens
SMLEQGKEPWTV

SEQ ID NO: 9264 - protein, 9 aa, Homo sapiens
SMLNDIAAV

SEQ ID NO: 9265 - protein, 9 aa, Homo sapiens
SMMDPNHFL

SEQ ID NO: 9266 - protein, 10 aa, Homo sapiens
SMMDVDHQIA

SEQ ID NO: 9267 - protein, 9 aa, Homo sapiens
SMPDIDLNL

SEQ ID NO: 9268 - protein, 9 aa, Homo sapiens
SMSDIDLNL

SEQ ID NO: 9269 - protein, 9 aa, Homo sapiens
SMSEVDLNV

SEQ ID NO: 9270 - protein, 9 aa, Homo sapiens
SMSGPLIGV

SEQ ID NO: 9271 - protein, 9 aa, Homo sapiens
SMSRSPPTV

SEQ ID NO: 9272 - protein, 11 aa, Homo sapiens
SMVEDITGLRL

SEQ ID NO: 9273 - protein, 11 aa, Homo sapiens
SMWDDINNVGL

SEQ ID NO: 9274 - protein, 9 aa, Homo sapiens
SQADVIPAV

SEQ ID NO: 9275 - protein, 9 aa, Homo sapiens
SQPDLLHQL

SEQ ID NO: 9276 - protein, 9 aa, Homo sapiens
SQQEIQHIV

SEQ ID NO: 9277 - protein, 11 aa, Homo sapiens
SSSEVISQHLV

SEQ ID NO: 9278 - protein, 11 aa, Homo sapiens
STFDAGAGIAL

SEQ ID NO: 9279 - protein, 10 aa, Homo sapiens
STHGKFHGTV

SEQ ID NO: 9280 - protein, 9 aa, Homo sapiens
SVADLIESM

SEQ ID NO: 9281 - protein, 10 aa, Homo sapiens
SVADLIESML

SEQ ID NO: 9282 - protein, 12 aa, Homo sapiens
SVAGEVVFNTGL

SEQ ID NO: 9283 - protein, 9 aa, Homo sapiens
SVFKLLPQL

SEQ ID NO: 9284 - protein, 11 aa, Homo sapiens
SVFLFNTENKL

SEQ ID NO: 9285 - protein, 9 aa, Homo sapiens
SVLGAITSV

SEQ ID NO: 9286 - protein, 11 aa, Homo sapiens
SVLGDILGSAM

SEQ ID NO: 9287 - protein, 9 aa, Homo sapiens
SVLPKPALV

SEQ ID NO: 9288 - protein, 10 aa, Homo sapiens
SVLSTGVPTV

SEQ ID NO: 9289 - protein, 9 aa, Homo sapiens
SVSGYSPSL

SEQ ID NO: 9290 - protein, 10 aa, Homo sapiens
SVSPVVRVAV

SEQ ID NO: 9291 - protein, 12 aa, Homo sapiens
SVWAAVPGKTFV

SEQ ID NO: 9292 - protein, 9 aa, Homo sapiens
SVWIGGSIL

SEQ ID NO: 9293 - protein, 10 aa, Homo sapiens
SVWIGGSILA

SEQ ID NO: 9294 - protein, 11 aa, Homo sapiens
TIAGGGVIPHI

SEQ ID NO: 9295 - protein, 9 aa, Homo sapiens
TIDDGIFEV

SEQ ID NO: 9296 - protein, 9 aa, Homo sapiens
TIDNGVFEV

SEQ ID NO: 9297 - protein, 9 aa, Homo sapiens
TIEDGIFEV

SEQ ID NO: 9298 - protein, 10 aa, Homo sapiens
TIFTGHTAVV

SEQ ID NO: 9299 - protein, 9 aa, Homo sapiens
TIIEFLSFL

SEQ ID NO: 9300 - protein, 12 aa, Homo sapiens
TIIGSFNGALAA

SEQ ID NO: 9301 - protein, 9 aa, Homo sapiens
TISEGAHHL

SEQ ID NO: 9302 - protein, 10 aa, Homo sapiens
TISQGAIEKV

SEQ ID NO: 9303 - protein, 12 aa, Homo sapiens
TIYGDLKVGDQV

SEQ ID NO: 9304 - protein, 9 aa, Homo sapiens
TLAAEMQEL

SEQ ID NO: 9305 - protein, 11 aa, Homo sapiens
TLAAEMQELRV

SEQ ID NO: 9306 - protein, 10 aa, Homo sapiens
TLADLQLEYL

SEQ ID NO: 9307 - protein, 12 aa, Homo sapiens
TLADLTLAQLLA

SEQ ID NO: 9308 - protein, 9 aa, Homo sapiens
TLAEDLMQL

SEQ ID NO: 9309 - protein, 11 aa, Homo sapiens
TLAEEFTYNPF

SEQ ID NO: 9310 - protein, 8 aa, Homo sapiens
TLAEIAKV

SEQ ID NO: 9311 - protein, 9 aa, Homo sapiens
TLAELDVTL

SEQ ID NO: 9312 - protein, 9 aa, Homo sapiens
TLAELLVLL

SEQ ID NO: 9313 - protein, 11 aa, Homo sapiens
TLAELQPPVQL

SEQ ID NO: 9314 - protein, 9 aa, Homo sapiens
TLAERSAGL

SEQ ID NO: 9315 - protein, 9 aa, Homo sapiens
TLAESALQL

SEQ ID NO: 9316 - protein, 10 aa, Homo sapiens
TLAESALQLL

SEQ ID NO: 9317 - protein, 12 aa, Homo sapiens
TLAESLGGFESL

SEQ ID NO: 9318 - protein, 9 aa, Homo sapiens
TLAESSDHV

SEQ ID NO: 9319 - protein, 9 aa, Homo sapiens
TLAETIQGL

SEQ ID NO: 9320 - protein, 9 aa, Homo sapiens
TLAFAIPMI

SEQ ID NO: 9321 - protein, 11 aa, Homo sapiens
TLAFLIPAVEL

SEQ ID NO: 9322 - protein, 11 aa, Homo sapiens
TLAGKITGMLL

SEQ ID NO: 9323 - protein, 9 aa, Homo sapiens
TLAGLPLLV

SEQ ID NO: 9324 - protein, 11 aa, Homo sapiens
TLAMDTILANA

SEQ ID NO: 9325 - protein, 12 aa, Homo sapiens
TLANGVLASLNL

SEQ ID NO: 9326 - protein, 10 aa, Homo sapiens
TLASDMQWKV

SEQ ID NO: 9327 - protein, 9 aa, Homo sapiens
TLAYLLPAI

SEQ ID NO: 9328 - protein, 10 aa, Homo sapiens
TLAYLLPAIV

SEQ ID NO: 9329 - protein, 9 aa, Homo sapiens
TLDAAISKV

SEQ ID NO: 9330 - protein, 9 aa, Homo sapiens
TLDDIKEWL

SEQ ID NO: 9331 - protein, 8 aa, Homo sapiens
TLDDVQAF

SEQ ID NO: 9332 - protein, 9 aa, Homo sapiens
TLDDVQAFL

SEQ ID NO: 9333 - protein, 9 aa, Homo sapiens
TLDEAFEEL

SEQ ID NO: 9334 - protein, 12 aa, Homo sapiens
TLDEILDETQHL

SEQ ID NO: 9335 - protein, 12 aa, Homo sapiens
TLDELSQGTTTV

SEQ ID NO: 9336 - protein, 9 aa, Homo sapiens
TLDGTISVV

SEQ ID NO: 9337 - protein, 9 aa, Homo sapiens
TLDGVKSWL

SEQ ID NO: 9338 - protein, 9 aa, Homo sapiens
TLDHPIIPA

SEQ ID NO: 9339 - protein, 9 aa, Homo sapiens
TLDLSNNQL

SEQ ID NO: 9340 - protein, 9 aa, Homo sapiens
TLDPAIVSA

SEQ ID NO: 9341 - protein, 11 aa, Homo sapiens
TLDPETGLLFL

SEQ ID NO: 9342 - protein, 10 aa, Homo sapiens
TLDPHNVDYL

SEQ ID NO: 9343 - protein, 9 aa, Homo sapiens
TLDPSLMEM

SEQ ID NO: 9344 - protein, 10 aa, Homo sapiens
TLDSLSIHQL

SEQ ID NO: 9345 - protein, 11 aa, Homo sapiens
TLDSLSIHQLA

SEQ ID NO: 9346 - protein, 9 aa, Homo sapiens
TLDVFNITI

SEQ ID NO: 9347 - protein, 9 aa, Homo sapiens
TLEGTPVFV

SEQ ID NO: 9348 - protein, 11 aa, Homo sapiens
TLFATEDALEV

SEQ ID NO: 9349 - protein, 11 aa, Homo sapiens
TLFATGKWVGV

SEQ ID NO: 9350 - protein, 12 aa, Homo sapiens
TLFDILVAGGML

SEQ ID NO: 9351 - protein, 12 aa, Homo sapiens
TLFGFLGKIDEL

SEQ ID NO: 9352 - protein, 10 aa, Homo sapiens
TLFGGEVCKV

SEQ ID NO: 9353 - protein, 9 aa, Homo sapiens
TLFGMITAV

SEQ ID NO: 9354 - protein, 10 aa, Homo sapiens
TLFSLGLISV

SEQ ID NO: 9355 - protein, 11 aa, Homo sapiens
TLGEIPTYGLA

SEQ ID NO: 9356 - protein, 12 aa, Homo sapiens
TLGFSVEGPSQA

SEQ ID NO: 9357 - protein, 11 aa, Homo sapiens
TLGGLEMELRL

SEQ ID NO: 9358 - protein, 9 aa, Homo sapiens
TLGKDHPAV

SEQ ID NO: 9359 - protein, 10 aa, Homo sapiens
TLGKFTVPML

SEQ ID NO: 9360 - protein, 9 aa, Homo sapiens
TLGQFYQEV

SEQ ID NO: 9361 - protein, 10 aa, Homo sapiens
TLGQFYQEVL

SEQ ID NO: 9362 - protein, 8 aa, Homo sapiens
TLGQIWDV

SEQ ID NO: 9363 - protein, 10 aa, Homo sapiens
TLGSFSGLRV

SEQ ID NO: 9364 - protein, 10 aa, Homo sapiens
TLGVDFIDVA

SEQ ID NO: 9365 - protein, 9 aa, Homo sapiens
TLGVEVHPL

SEQ ID NO: 9366 - protein, 10 aa, Homo sapiens
TLGVEVHPLV

SEQ ID NO: 9367 - protein, 11 aa, Homo sapiens
TLGVKQLIVGV

SEQ ID NO: 9368 - protein, 9 aa, Homo sapiens
TLHRYEHAL

SEQ ID NO: 9369 - protein, 10 aa, Homo sapiens
TLHSRFLEGV

SEQ ID NO: 9370 - protein, 12 aa, Homo sapiens
TLIDPETLLPRL

SEQ ID NO: 9371 - protein, 9 aa, Homo sapiens
TLIEEMLYL

SEQ ID NO: 9372 - protein, 10 aa, Homo sapiens
TLIELWEGLT

SEQ ID NO: 9373 - protein, 11 aa, Homo sapiens
TLIELWEGLTV

SEQ ID NO: 9374 - protein, 12 aa, Homo sapiens
TLIGIPPAPRGV

SEQ ID NO: 9375 - protein, 9 aa, Homo sapiens
TLIGYFVGL

SEQ ID NO: 9376 - protein, 10 aa, Homo sapiens
TLIRVPIPQV

SEQ ID NO: 9377 - protein, 9 aa, Homo sapiens
TLISFIYPA

SEQ ID NO: 9378 - protein, 9 aa, Homo sapiens
TLKEEMESL

SEQ ID NO: 9379 - protein, 12 aa, Homo sapiens
TLKEMIKSGMNV

SEQ ID NO: 9380 - protein, 10 aa, Homo sapiens
TLKESFDGSV

SEQ ID NO: 9381 - protein, 11 aa, Homo sapiens
TLKEVEELEQL

SEQ ID NO: 9382 - protein, 10 aa, Homo sapiens
TLKMSVQPTV

SEQ ID NO: 9383 - protein, 10 aa, Homo sapiens
TLLANGGHGV

SEQ ID NO: 9384 - protein, 9 aa, Homo sapiens
TLLDAELFL

SEQ ID NO: 9385 - protein, 9 aa, Homo sapiens
TLLDALYEI

SEQ ID NO: 9386 - protein, 9 aa, Homo sapiens
TLLDSTWNL

SEQ ID NO: 9387 - protein, 9 aa, Homo sapiens
TLLEDAIEV

SEQ ID NO: 9388 - protein, 9 aa, Homo sapiens
TLLEEVQEL

SEQ ID NO: 9389 - protein, 11 aa, Homo sapiens
TLLEISDLNEL

SEQ ID NO: 9390 - protein, 12 aa, Homo sapiens
TLLEISDLNELL

SEQ ID NO: 9391 - protein, 8 aa, Homo sapiens
TLLEKDYF

SEQ ID NO: 9392 - protein, 10 aa, Homo sapiens
TLLEVGQIAV

SEQ ID NO: 9393 - protein, 9 aa, Homo sapiens
TLLGFDDFV

SEQ ID NO: 9394 - protein, 11 aa, Homo sapiens
TLLGFDDFVNM

SEQ ID NO: 9395 - protein, 12 aa, Homo sapiens
TLLGFDDFVNMV

SEQ ID NO: 9396 - protein, 9 aa, Homo sapiens
TLLIKTVET

SEQ ID NO: 9397 - protein, 9 aa, Homo sapiens
TLLNSEVHM

SEQ ID NO: 9398 - protein, 11 aa, Homo sapiens
TLLNSEVHMLL

SEQ ID NO: 9399 - protein, 10 aa, Homo sapiens
TLLPDLIQKV

SEQ ID NO: 9400 - protein, 12 aa, Homo sapiens
TLLPDLIQKVLT

SEQ ID NO: 9401 - protein, 9 aa, Homo sapiens
TLLSEIAEL

SEQ ID NO: 9402 - protein, 11 aa, Homo sapiens
TLLSEIAELEL

SEQ ID NO: 9403 - protein, 9 aa, Homo sapiens
TLLSNLEEA

SEQ ID NO: 9404 - protein, 10 aa, Homo sapiens
TLLTLTGNYL

SEQ ID NO: 9405 - protein, 9 aa, Homo sapiens
TLMDLSTKA

SEQ ID NO: 9406 - protein, 12 aa, Homo sapiens
TLMDLSTKAFAM

SEQ ID NO: 9407 - protein, 10 aa, Homo sapiens
TLMEDVENSF

SEQ ID NO: 9408 - protein, 11 aa, Homo sapiens
TLMEDVENSFF

SEQ ID NO: 9409 - protein, 12 aa, Homo sapiens
TLMEDVENSFFL

SEQ ID NO: 9410 - protein, 10 aa, Homo sapiens
TLMEQTLPVT

SEQ ID NO: 9411 - protein, 11 aa, Homo sapiens
TLMEQTLPVTV

SEQ ID NO: 9412 - protein, 9 aa, Homo sapiens
TLMNTIMQL

SEQ ID NO: 9413 - protein, 9 aa, Homo sapiens
TLNAHEHFV

SEQ ID NO: 9414 - protein, 12 aa, Homo sapiens
TLNDELEIIEGM

SEQ ID NO: 9415 - protein, 10 aa, Homo sapiens
TLNDGAAALV

SEQ ID NO: 9416 - protein, 11 aa, Homo sapiens
TLNDGAAALVL

SEQ ID NO: 9417 - protein, 12 aa, Homo sapiens
TLNDGAAALVLM

SEQ ID NO: 9418 - protein, 10 aa, Homo sapiens
TLNDGVVVQV

SEQ ID NO: 9419 - protein, 10 aa, Homo sapiens
TLNDREYQLL

SEQ ID NO: 9420 - protein, 9 aa, Homo sapiens
TLNEALEFA

SEQ ID NO: 9421 - protein, 9 aa, Homo sapiens
TLNKFIEEL

SEQ ID NO: 9422 - protein, 9 aa, Homo sapiens
TLNMKTVYV

SEQ ID NO: 9423 - protein, 9 aa, Homo sapiens
TLPVDFVTA

SEQ ID NO: 9424 - protein, 11 aa, Homo sapiens
TLQEAEAFVGA

SEQ ID NO: 9425 - protein, 9 aa, Homo sapiens
TLQEFLKLA

SEQ ID NO: 9426 - protein, 9 aa, Homo sapiens
TLQEVFEKA

SEQ ID NO: 9427 - protein, 11 aa, Homo sapiens
TLQEVTEMDSV

SEQ ID NO: 9428 - protein, 9 aa, Homo sapiens
TLQEWLTEV

SEQ ID NO: 9429 - protein, 9 aa, Homo sapiens
TLQGNTREV

SEQ ID NO: 9430 - protein, 9 aa, Homo sapiens
TLQHAEIFL

SEQ ID NO: 9431 - protein, 9 aa, Homo sapiens
TLQIFNIEM

SEQ ID NO: 9432 - protein, 9 aa, Homo sapiens
TLQKPSPEL

SEQ ID NO: 9433 - protein, 9 aa, Homo sapiens
TLQSEVKPI

SEQ ID NO: 9434 - protein, 10 aa, Homo sapiens
TLQSEVKPIL

SEQ ID NO: 9435 - protein, 9 aa, Homo sapiens
TLSDFLTEI

SEQ ID NO: 9436 - protein, 9 aa, Homo sapiens
TLSDVVVGL

SEQ ID NO: 9437 - protein, 11 aa, Homo sapiens
TLSEDSPYETL

SEQ ID NO: 9438 - protein, 9 aa, Homo sapiens
TLSELKTVL

SEQ ID NO: 9439 - protein, 11 aa, Homo sapiens
TLSMSADVPLV

SEQ ID NO: 9440 - protein, 9 aa, Homo sapiens
TLSNAEFQM

SEQ ID NO: 9441 - protein, 9 aa, Homo sapiens
TLSNKSYSV

SEQ ID NO: 9442 - protein, 9 aa, Homo sapiens
TLSPEMITV

SEQ ID NO: 9443 - protein, 12 aa, Homo sapiens
TLSYLLPAIVHI

SEQ ID NO: 9444 - protein, 8 aa, Homo sapiens
TLTGVHQV

SEQ ID NO: 9445 - protein, 9 aa, Homo sapiens
TLTQVSPQM

SEQ ID NO: 9446 - protein, 9 aa, Homo sapiens
TLTRAVTTV

SEQ ID NO: 9447 - protein, 9 aa, Homo sapiens
TLWNGQKLV

SEQ ID NO: 9448 - protein, 11 aa, Homo sapiens
TLWNGQKLVTT

SEQ ID NO: 9449 - protein, 11 aa, Homo sapiens
TLYANGSRTET

SEQ ID NO: 9450 - protein, 10 aa, Homo sapiens
TLYDIAHTPG

SEQ ID NO: 9451 - protein, 12 aa, Homo sapiens
TLYDIAHTPGVA

SEQ ID NO: 9452 - protein, 10 aa, Homo sapiens
TLYEVKSENL

SEQ ID NO: 9453 - protein, 9 aa, Homo sapiens
TLYNNTIKV

SEQ ID NO: 9454 - protein, 9 aa, Homo sapiens
TLYSGLDEV

SEQ ID NO: 9455 - protein, 11 aa, Homo sapiens
TLYTYPENWRA

SEQ ID NO: 9456 - protein, 9 aa, Homo sapiens
TMDGANVEM

SEQ ID NO: 9457 - protein, 9 aa, Homo sapiens
TMGEGPDKA

SEQ ID NO: 9458 - protein, 12 aa, Homo sapiens
TMHDVDAESFEV

SEQ ID NO: 9459 - protein, 9 aa, Homo sapiens
TMIKGLYGI

SEQ ID NO: 9460 - protein, 11 aa, Homo sapiens
TMLDVEGLFYL

SEQ ID NO: 9461 - protein, 10 aa, Homo sapiens
TMLFLGLHNV

SEQ ID NO: 9462 - protein, 10 aa, Homo sapiens
TMQELIGLYV

SEQ ID NO: 9463 - protein, 9 aa, Homo sapiens
TTPEEIAQV

SEQ ID NO: 9464 - protein, 11 aa, Homo sapiens
TVAEINATMSV

SEQ ID NO: 9465 - protein, 10 aa, Homo sapiens
TVDDPYATFV

SEQ ID NO: 9466 - protein, 9 aa, Homo sapiens
TVDISPDTV

SEQ ID NO: 9467 - protein, 9 aa, Homo sapiens
TVIGELPPA

SEQ ID NO: 9468 - protein, 10 aa, Homo sapiens
TVIHFNNPKV

SEQ ID NO: 9469 - protein, 10 aa, Homo sapiens
TVLKAQFPSV

SEQ ID NO: 9470 - protein, 10 aa, Homo sapiens
TVMGAEIRHV

SEQ ID NO: 9471 - protein, 12 aa, Homo sapiens
TVMGAEIRHVLV

SEQ ID NO: 9472 - protein, 10 aa, Homo sapiens
TVMGAELRHV

SEQ ID NO: 9473 - protein, 9 aa, Homo sapiens
TVSEAPPLL

SEQ ID NO: 9474 - protein, 9 aa, Homo sapiens
TVTNAVVTV

SEQ ID NO: 9475 - protein, 9 aa, Homo sapiens
TVYGGLMYI

SEQ ID NO: 9476 - protein, 9 aa, Homo sapiens
TVYGGVMYI

SEQ ID NO: 9477 - protein, 9 aa, Homo sapiens
VAYKNVVGA

SEQ ID NO: 9478 - protein, 10 aa, Homo sapiens
VIDPATATSV

SEQ ID NO: 9479 - protein, 12 aa, Homo sapiens
VIHDNFGIVEGL

SEQ ID NO: 9480 - protein, 12 aa, Homo sapiens
VIIEQSWGSPKV

SEQ ID NO: 9481 - protein, 11 aa, Homo sapiens
VILKILPTLEA

SEQ ID NO: 9482 - protein, 10 aa, Homo sapiens
VILPVPAFNV

SEQ ID NO: 9483 - protein, 10 aa, Homo sapiens
VILTGTPPGV

SEQ ID NO: 9484 - protein, 11 aa, Homo sapiens
VIMFLGDGMGV

SEQ ID NO: 9485 - protein, 11 aa, Homo sapiens
VIMSIEEKMEA

SEQ ID NO: 9486 - protein, 9 aa, Homo sapiens
VINGNPITI

SEQ ID NO: 9487 - protein, 9 aa, Homo sapiens
VIWGTDVNV

SEQ ID NO: 9488 - protein, 9 aa, Homo sapiens
VLAAVYKAL

SEQ ID NO: 9489 - protein, 11 aa, Homo sapiens
VLADHARTITV

SEQ ID NO: 9490 - protein, 11 aa, Homo sapiens
VLADLGSKTLT

SEQ ID NO: 9491 - protein, 9 aa, Homo sapiens
VLAEEPEAV

SEQ ID NO: 9492 - protein, 12 aa, Homo sapiens
VLAEFDTPGHTL

SEQ ID NO: 9493 - protein, 9 aa, Homo sapiens
VLAGDVTDV

SEQ ID NO: 9494 - protein, 11 aa, Homo sapiens
VLAGDVTDVLL

SEQ ID NO: 9495 - protein, 12 aa, Homo sapiens
VLAGDVTDVLLL

SEQ ID NO: 9496 - protein, 9 aa, Homo sapiens
VLANVTHLL

SEQ ID NO: 9497 - protein, 9 aa, Homo sapiens
VLAPGPPQA

SEQ ID NO: 9498 - protein, 9 aa, Homo sapiens
VLAPLIALV

SEQ ID NO: 9499 - protein, 12 aa, Homo sapiens
VLAPMPLAEVEL

SEQ ID NO: 9500 - protein, 9 aa, Homo sapiens
VLAPPPEEV

SEQ ID NO: 9501 - protein, 9 aa, Homo sapiens
VLATVTKPV

SEQ ID NO: 9502 - protein, 12 aa, Homo sapiens
VLAYEPVWAIGT

SEQ ID NO: 9503 - protein, 10 aa, Homo sapiens
VLCNSEDIRL

SEQ ID NO: 9504 - protein, 11 aa, Homo sapiens
VLDDIQDLIYF

SEQ ID NO: 9505 - protein, 8 aa, Homo sapiens
VLDDKDYF

SEQ ID NO: 9506 - protein, 9 aa, Homo sapiens
VLDEADEML

SEQ ID NO: 9507 - protein, 9 aa, Homo sapiens
VLDEAGSTV

SEQ ID NO: 9508 - protein, 9 aa, Homo sapiens
VLDEGKMKL

SEQ ID NO: 9509 - protein, 9 aa, Homo sapiens
VLDEGKVNM

SEQ ID NO: 9510 - protein, 9 aa, Homo sapiens
VLDEGLTSV

SEQ ID NO: 9511 - protein, 9 aa, Homo sapiens
VLDEGSASV

SEQ ID NO: 9512 - protein, 9 aa, Homo sapiens
VLDELDMEL

SEQ ID NO: 9513 - protein, 9 aa, Homo sapiens
VLDEVDQML

SEQ ID NO: 9514 - protein, 10 aa, Homo sapiens
VLDFEHFLPM

SEQ ID NO: 9515 - protein, 9 aa, Homo sapiens
VLDGADCIM

SEQ ID NO: 9516 - protein, 9 aa, Homo sapiens
VLDGVLMEL

SEQ ID NO: 9517 - protein, 9 aa, Homo sapiens
VLDLDFPAL

SEQ ID NO: 9518 - protein, 9 aa, Homo sapiens
VLDLLTSYL

SEQ ID NO: 9519 - protein, 9 aa, Homo sapiens
VLDLRAFYA

SEQ ID NO: 9520 - protein, 9 aa, Homo sapiens
VLDNLLAFV

SEQ ID NO: 9521 - protein, 8 aa, Homo sapiens
VLDNPYPV

SEQ ID NO: 9522 - protein, 9 aa, Homo sapiens
VLDPESVEL

SEQ ID NO: 9523 - protein, 11 aa, Homo sapiens
VLDPNMDLRTV

SEQ ID NO: 9524 - protein, 12 aa, Homo sapiens
VLDPSGSMNIYL

SEQ ID NO: 9525 - protein, 11 aa, Homo sapiens
VLDPSMVILEV

SEQ ID NO: 9526 - protein, 12 aa, Homo sapiens
VLDSGAPIKIPV

SEQ ID NO: 9527 - protein, 9 aa, Homo sapiens
VLDTNDRFL

SEQ ID NO: 9528 - protein, 9 aa, Homo sapiens
VLDVDLQGV

SEQ ID NO: 9529 - protein, 11 aa, Homo sapiens
VLDVESGNISV

SEQ ID NO: 9530 - protein, 10 aa, Homo sapiens
VLEDGPWKTV

SEQ ID NO: 9531 - protein, 11 aa, Homo sapiens
VLEDVTGEEFV

SEQ ID NO: 9532 - protein, 12 aa, Homo sapiens
VLEDVTGEEFVL

SEQ ID NO: 9533 - protein, 9 aa, Homo sapiens
VLEEFVPEI

SEQ ID NO: 9534 - protein, 9 aa, Homo sapiens
VLEKLGVTV

SEQ ID NO: 9535 - protein, 9 aa, Homo sapiens
VLEKSLLNV

SEQ ID NO: 9536 - protein, 10 aa, Homo sapiens
VLFAVNNMFV

SEQ ID NO: 9537 - protein, 8 aa, Homo sapiens
VLFEDVYE

SEQ ID NO: 9538 - protein, 9 aa, Homo sapiens
VLFEDVYEL

SEQ ID NO: 9539 - protein, 12 aa, Homo sapiens
VLFEHAVGYALL

SEQ ID NO: 9540 - protein, 9 aa, Homo sapiens
VLFENTDSV

SEQ ID NO: 9541 - protein, 11 aa, Homo sapiens
VLFEYIPQNED

SEQ ID NO: 9542 - protein, 9 aa, Homo sapiens
VLFLGELYL

SEQ ID NO: 9543 - protein, 9 aa, Homo sapiens
VLFLKPSTA

SEQ ID NO: 9544 - protein, 11 aa, Homo sapiens
VLFNVNSDTRL

SEQ ID NO: 9545 - protein, 10 aa, Homo sapiens
VLFSSPPVIL

SEQ ID NO: 9546 - protein, 12 aa, Homo sapiens
VLFTDEGVPKFL

SEQ ID NO: 9547 - protein, 8 aa, Homo sapiens
VLGAITSV

SEQ ID NO: 9548 - protein, 9 aa, Homo sapiens
VLGEGVPIL

SEQ ID NO: 9549 - protein, 12 aa, Homo sapiens
VLGEHGDSSVPV

SEQ ID NO: 9550 - protein, 11 aa, Homo sapiens
VLGETQDFHSL

SEQ ID NO: 9551 - protein, 11 aa, Homo sapiens
VLGEVGSGFKV

SEQ ID NO: 9552 - protein, 8 aa, Homo sapiens
VLGFVKVA

SEQ ID NO: 9553 - protein, 9 aa, Homo sapiens
VLGLDLWQV

SEQ ID NO: 9554 - protein, 9 aa, Homo sapiens
VLGRTIWGV

SEQ ID NO: 9555 - protein, 11 aa, Homo sapiens
VLGTVGFGSGL

SEQ ID NO: 9556 - protein, 9 aa, Homo sapiens
VLHDISSLL

SEQ ID NO: 9557 - protein, 10 aa, Homo sapiens
VLHDISSLLS

SEQ ID NO: 9558 - protein, 9 aa, Homo sapiens
VLHEKTPVS

SEQ ID NO: 9559 - protein, 9 aa, Homo sapiens
VLHNGPEEV

SEQ ID NO: 9560 - protein, 10 aa, Homo sapiens
VLIDIREYWM

SEQ ID NO: 9561 - protein, 9 aa, Homo sapiens
VLIGSNHSL

SEQ ID NO: 9562 - protein, 11 aa, Homo sapiens
VLIIGELLKQA

SEQ ID NO: 9563 - protein, 10 aa, Homo sapiens
VLIMELINNV

SEQ ID NO: 9564 - protein, 11 aa, Homo sapiens
VLISLKQAPLV

SEQ ID NO: 9565 - protein, 9 aa, Homo sapiens
VLKAQFPSV

SEQ ID NO: 9566 - protein, 9 aa, Homo sapiens
VLKDYIAYA

SEQ ID NO: 9567 - protein, 10 aa, Homo sapiens
VLKEEASDYL

SEQ ID NO: 9568 - protein, 12 aa, Homo sapiens
VLKEEASDYLEL

SEQ ID NO: 9569 - protein, 9 aa, Homo sapiens
VLKEYLDNV

SEQ ID NO: 9570 - protein, 9 aa, Homo sapiens
VLLDEDDDL

SEQ ID NO: 9571 - protein, 10 aa, Homo sapiens
VLLDGETFEV

SEQ ID NO: 9572 - protein, 9 aa, Homo sapiens
VLLDLISEV

SEQ ID NO: 9573 - protein, 9 aa, Homo sapiens
VLLDPPLIA

SEQ ID NO: 9574 - protein, 10 aa, Homo sapiens
VLLDPPLIAL

SEQ ID NO: 9575 - protein, 10 aa, Homo sapiens
VLLEDLASQV

SEQ ID NO: 9576 - protein, 12 aa, Homo sapiens
VLLEDLASQVGL

SEQ ID NO: 9577 - protein, 11 aa, Homo sapiens
VLLEDVDAAFL

SEQ ID NO: 9578 - protein, 9 aa, Homo sapiens
VLLEEPVVL

SEQ ID NO: 9579 - protein, 10 aa, Homo sapiens
VLLEEPVVLA

SEQ ID NO: 9580 - protein, 10 aa, Homo sapiens
VLLEIEDLQV

SEQ ID NO: 9581 - protein, 9 aa, Homo sapiens
VLLFETALL

SEQ ID NO: 9582 - protein, 8 aa, Homo sapiens
VLLGKVYV

SEQ ID NO: 9583 - protein, 12 aa, Homo sapiens
VLLGQDEPLIHV

SEQ ID NO: 9584 - protein, 11 aa, Homo sapiens
VLLLDVTPLSL

SEQ ID NO: 9585 - protein, 11 aa, Homo sapiens
VLLPEYGGTKV

SEQ ID NO: 9586 - protein, 12 aa, Homo sapiens
VLLSPLSVATAL

SEQ ID NO: 9587 - protein, 12 aa, Homo sapiens
VLLTLQKPSPEL

SEQ ID NO: 9588 - protein, 9 aa, Homo sapiens
VLLTQLIKA

SEQ ID NO: 9589 - protein, 11 aa, Homo sapiens
VLMDIQASTVV

SEQ ID NO: 9590 - protein, 12 aa, Homo sapiens
VLMDLKALLLEA

SEQ ID NO: 9591 - protein, 12 aa, Homo sapiens
VLMDVTGGPFDL

SEQ ID NO: 9592 - protein, 9 aa, Homo sapiens
VLMEHGVPV

SEQ ID NO: 9593 - protein, 9 aa, Homo sapiens
VLMEIIAKV

SEQ ID NO: 9594 - protein, 10 aa, Homo sapiens
VLMNEILHGA

SEQ ID NO: 9595 - protein, 10 aa, Homo sapiens
VLMNPNIASV

SEQ ID NO: 9596 - protein, 12 aa, Homo sapiens
VLMNPNIASVQT

SEQ ID NO: 9597 - protein, 11 aa, Homo sapiens
VLMNQPPQIAP

SEQ ID NO: 9598 - protein, 12 aa, Homo sapiens
VLMRANIQAVSL

SEQ ID NO: 9599 - protein, 11 aa, Homo sapiens
VLMTADAAKRL

SEQ ID NO: 9600 - protein, 10 aa, Homo sapiens
VLMTQQPRPV

SEQ ID NO: 9601 - protein, 9 aa, Homo sapiens
VLMVEVENV

SEQ ID NO: 9602 - protein, 9 aa, Homo sapiens
VLNNMEIGT

SEQ ID NO: 9603 - protein, 9 aa, Homo sapiens
VLPGLIHKV

SEQ ID NO: 9604 - protein, 9 aa, Homo sapiens
VLPLTVAEV

SEQ ID NO: 9605 - protein, 9 aa, Homo sapiens
VLPPPPPHA

SEQ ID NO: 9606 - protein, 9 aa, Homo sapiens
VLPSFTPYV

SEQ ID NO: 9607 - protein, 8 aa, Homo sapiens
VLQATVVA

SEQ ID NO: 9608 - protein, 9 aa, Homo sapiens
VLQATVVAV

SEQ ID NO: 9609 - protein, 9 aa, Homo sapiens
VLQEAPWEV

SEQ ID NO: 9610 - protein, 10 aa, Homo sapiens
VLQGDLVMNV

SEQ ID NO: 9611 - protein, 9 aa, Homo sapiens
VLQGELEAV

SEQ ID NO: 9612 - protein, 9 aa, Homo sapiens
VLQPAPHQV

SEQ ID NO: 9613 - protein, 11 aa, Homo sapiens
VLQPLIAEHQA

SEQ ID NO: 9614 - protein, 9 aa, Homo sapiens
VLQVLLSQV

SEQ ID NO: 9615 - protein, 10 aa, Homo sapiens
VLQVVNLPIV

SEQ ID NO: 9616 - protein, 10 aa, Homo sapiens
VLRYQDTPGV

SEQ ID NO: 9617 - protein, 9 aa, Homo sapiens
VLSDSRPAM

SEQ ID NO: 9618 - protein, 10 aa, Homo sapiens
VLSEFELRLL

SEQ ID NO: 9619 - protein, 9 aa, Homo sapiens
VLSEPVLFL

SEQ ID NO: 9620 - protein, 11 aa, Homo sapiens
VLSIGDGIARV

SEQ ID NO: 9621 - protein, 10 aa, Homo sapiens
VLSSLTPAKV

SEQ ID NO: 9622 - protein, 9 aa, Homo sapiens
VLSTGVPTV

SEQ ID NO: 9623 - protein, 9 aa, Homo sapiens
VLTDTTAEL

SEQ ID NO: 9624 - protein, 11 aa, Homo sapiens
VLTEHVAAAEL

SEQ ID NO: 9625 - protein, 11 aa, Homo sapiens
VLTEKITPLEI

SEQ ID NO: 9626 - protein, 9 aa, Homo sapiens
VLTGHNHYV

SEQ ID NO: 9627 - protein, 11 aa, Homo sapiens
VLTSVNLFIGI

SEQ ID NO: 9628 - protein, 11 aa, Homo sapiens
VLVDEDGPATV

SEQ ID NO: 9629 - protein, 12 aa, Homo sapiens
VLVDIKDTEPLI

SEQ ID NO: 9630 - protein, 12 aa, Homo sapiens
VLVGGSTRIPKV

SEQ ID NO: 9631 - protein, 9 aa, Homo sapiens
VLVPTVSMV

SEQ ID NO: 9632 - protein, 11 aa, Homo sapiens
VLVSGLRGLGV

SEQ ID NO: 9633 - protein, 9 aa, Homo sapiens
VLWGALYPL

SEQ ID NO: 9634 - protein, 10 aa, Homo sapiens
VLWGALYPLL

SEQ ID NO: 9635 - protein, 9 aa, Homo sapiens
VLWNKTVTA

SEQ ID NO: 9636 - protein, 9 aa, Homo sapiens
VLWRGETAV

SEQ ID NO: 9637 - protein, 9 aa, Homo sapiens
VLWTGPKVV

SEQ ID NO: 9638 - protein, 11 aa, Homo sapiens
VLYEDSLSSQV

SEQ ID NO: 9639 - protein, 9 aa, Homo sapiens
VLYEMLYGL

SEQ ID NO: 9640 - protein, 9 aa, Homo sapiens
VLYGDVEEL

SEQ ID NO: 9641 - protein, 12 aa, Homo sapiens
VMDSGDGVTHTV

SEQ ID NO: 9642 - protein, 9 aa, Homo sapiens
VMDTHLVNI

SEQ ID NO: 9643 - protein, 10 aa, Homo sapiens
VMFDDAIERA

SEQ ID NO: 9644 - protein, 12 aa, Homo sapiens
VMISTEWAAPNV

SEQ ID NO: 9645 - protein, 9 aa, Homo sapiens
VMKFSVSPV

SEQ ID NO: 9646 - protein, 12 aa, Homo sapiens
VMLAVDAVIAEL

SEQ ID NO: 9647 - protein, 9 aa, Homo sapiens
VMLGETNPA

SEQ ID NO: 9648 - protein, 9 aa, Homo sapiens
VMMETENRL

SEQ ID NO: 9649 - protein, 9 aa, Homo sapiens
VMQPHVPHA

SEQ ID NO: 9650 - protein, 8 aa, Homo sapiens
VQAPDWHL

SEQ ID NO: 9651 - protein, 10 aa, Homo sapiens
VQFELHYQEV

SEQ ID NO: 9652 - protein, 11 aa, Homo sapiens
VQPEATQVPLV

SEQ ID NO: 9653 - protein, 9 aa, Homo sapiens
VSTPTLVEV

SEQ ID NO: 9654 - protein, 10 aa, Homo sapiens
VTLNVLADSV

SEQ ID NO: 9655 - protein, 11 aa, Homo sapiens
VVADTPELQRI

SEQ ID NO: 9656 - protein, 11 aa, Homo sapiens
VVAMVWEGLNV

SEQ ID NO: 9657 - protein, 12 aa, Homo sapiens
VVAMVWEGLNVV

SEQ ID NO: 9658 - protein, 9 aa, Homo sapiens
VVDEGPTGV

SEQ ID NO: 9659 - protein, 12 aa, Homo sapiens
VVIAHDVDPIEL

SEQ ID NO: 9660 - protein, 10 aa, Homo sapiens
VVLDDKDYFL

SEQ ID NO: 9661 - protein, 9 aa, Homo sapiens
VVMGTVPRL

SEQ ID NO: 9662 - protein, 9 aa, Homo sapiens
VVYGEPITA

SEQ ID NO: 9663 - protein, 10 aa, Homo sapiens
WLDEHTLVTT

SEQ ID NO: 9664 - protein, 10 aa, Homo sapiens
WLNENAVEKV

SEQ ID NO: 9665 - protein, 10 aa, Homo sapiens
WLQDVFNVPL

SEQ ID NO: 9666 - protein, 12 aa, Homo sapiens
WLYNESPVRGTV

SEQ ID NO: 9667 - protein, 10 aa, Homo sapiens
WMDVGQGPGL

SEQ ID NO: 9668 - protein, 9 aa, Homo sapiens
YADKDVFHM

SEQ ID NO: 9669 - protein, 9 aa, Homo sapiens
YAFPKSITV

SEQ ID NO: 9670 - protein, 11 aa, Homo sapiens
YAGGTASATKV

SEQ ID NO: 9671 - protein, 11 aa, Homo sapiens
YGIENEVFLSL

SEQ ID NO: 9672 - protein, 11 aa, Homo sapiens
YGIKDDVFLSV

SEQ ID NO: 9673 - protein, 9 aa, Homo sapiens
YGLSWNPNL

SEQ ID NO: 9674 - protein, 9 aa, Homo sapiens
YGPPSTWSV

SEQ ID NO: 9675 - protein, 9 aa, Homo sapiens
YIAGHPAFV

SEQ ID NO: 9676 - protein, 9 aa, Homo sapiens
YIDKQPEEA

SEQ ID NO: 9677 - protein, 9 aa, Homo sapiens
YIDTNALRV

SEQ ID NO: 9678 - protein, 9 aa, Homo sapiens
YIGPDTPAL

SEQ ID NO: 9679 - protein, 9 aa, Homo sapiens
YIGPVLVSV

SEQ ID NO: 9680 - protein, 9 aa, Homo sapiens
YIGSVVISV

SEQ ID NO: 9681 - protein, 9 aa, Homo sapiens
YIHNILYEV

SEQ ID NO: 9682 - protein, 9 aa, Homo sapiens
YIKDGITRV

SEQ ID NO: 9683 - protein, 8 aa, Homo sapiens
YILDLQVV

SEQ ID NO: 9684 - protein, 9 aa, Homo sapiens
YILDLQVVL

SEQ ID NO: 9685 - protein, 11 aa, Homo sapiens
YILPQVSFTAV

SEQ ID NO: 9686 - protein, 12 aa, Homo sapiens
YILPTLEKELFL

SEQ ID NO: 9687 - protein, 9 aa, Homo sapiens
YILRELPKV

SEQ ID NO: 9688 - protein, 9 aa, Homo sapiens
YIQENLELV

SEQ ID NO: 9689 - protein, 10 aa, Homo sapiens
YISPDQLADL

SEQ ID NO: 9690 - protein, 9 aa, Homo sapiens
YITPFIRPV

SEQ ID NO: 9691 - protein, 9 aa, Homo sapiens
YIYDLLEEV

SEQ ID NO: 9692 - protein, 11 aa, Homo sapiens
YLAAVDKWLGV

SEQ ID NO: 9693 - protein, 9 aa, Homo sapiens
YLAAVLEYL

SEQ ID NO: 9694 - protein, 12 aa, Homo sapiens
YLADPMKARVVL

SEQ ID NO: 9695 - protein, 11 aa, Homo sapiens
YLADSTLSEEM

SEQ ID NO: 9696 - protein, 10 aa, Homo sapiens
YLADVVDSEA

SEQ ID NO: 9697 - protein, 11 aa, Homo sapiens
YLAEARNLPPL

SEQ ID NO: 9698 - protein, 12 aa, Homo sapiens
YLAEARNLPPLT

SEQ ID NO: 9699 - protein, 10 aa, Homo sapiens
YLAEDSNMSV

SEQ ID NO: 9700 - protein, 10 aa, Homo sapiens
YLAEFFVNEA

SEQ ID NO: 9701 - protein, 9 aa, Homo sapiens
YLAEKYEWD

SEQ ID NO: 9702 - protein, 11 aa, Homo sapiens
YLAEKYEWDVA

SEQ ID NO: 9703 - protein, 9 aa, Homo sapiens
YLAKLIFQM

SEQ ID NO: 9704 - protein, 12 aa, Homo sapiens
YLANLTQSQIAL

SEQ ID NO: 9705 - protein, 12 aa, Homo sapiens
YLAPENGYLMEA

SEQ ID NO: 9706 - protein, 9 aa, Homo sapiens
YLAPFDWKI

SEQ ID NO: 9707 - protein, 11 aa, Homo sapiens
YLAPHPFPHPA

SEQ ID NO: 9708 - protein, 11 aa, Homo sapiens
YLAPKIEDEEG

SEQ ID NO: 9709 - protein, 12 aa, Homo sapiens
YLAPKIEDEEGS

SEQ ID NO: 9710 - protein, 11 aa, Homo sapiens
YLAPSGPSGTL

SEQ ID NO: 9711 - protein, 9 aa, Homo sapiens
YLASPPLVI

SEQ ID NO: 9712 - protein, 12 aa, Homo sapiens
YLASPPLVIAYA

SEQ ID NO: 9713 - protein, 8 aa, Homo sapiens
YLASVFHA

SEQ ID NO: 9714 - protein, 9 aa, Homo sapiens
YLASVFHAT

SEQ ID NO: 9715 - protein, 11 aa, Homo sapiens
YLASVKAMHEA

SEQ ID NO: 9716 - protein, 9 aa, Homo sapiens
YLDDLLPKL

SEQ ID NO: 9717 - protein, 9 aa, Homo sapiens
YLDDLNEGV

SEQ ID NO: 9718 - protein, 10 aa, Homo sapiens
YLDDVSLHHL

SEQ ID NO: 9719 - protein, 12 aa, Homo sapiens
YLDDYGETDQGL

SEQ ID NO: 9720 - protein, 11 aa, Homo sapiens
YLDEAASAPAI

SEQ ID NO: 9721 - protein, 9 aa, Homo sapiens
YLDEDTIYH

SEQ ID NO: 9722 - protein, 8 aa, Homo sapiens
YLDEELMV

SEQ ID NO: 9723 - protein, 9 aa, Homo sapiens
YLDEELMVL

SEQ ID NO: 9724 - protein, 11 aa, Homo sapiens
YLDEIVKEVEA

SEQ ID NO: 9725 - protein, 9 aa, Homo sapiens
YLDENEKVV

SEQ ID NO: 9726 - protein, 10 aa, Homo sapiens
YLDENEKVVL

SEQ ID NO: 9727 - protein, 9 aa, Homo sapiens
YLDEPTVNT

SEQ ID NO: 9728 - protein, 9 aa, Homo sapiens
YLDEQIKKV

SEQ ID NO: 9729 - protein, 9 aa, Homo sapiens
YLDFINHYA

SEQ ID NO: 9730 - protein, 9 aa, Homo sapiens
YLDHAGATL

SEQ ID NO: 9731 - protein, 9 aa, Homo sapiens
YLDIDKGHV

SEQ ID NO: 9732 - protein, 10 aa, Homo sapiens
YLDINALQEL

SEQ ID NO: 9733 - protein, 9 aa, Homo sapiens
YLDIVKLLL

SEQ ID NO: 9734 - protein, 10 aa, Homo sapiens
YLDKPEEWHT

SEQ ID NO: 9735 - protein, 9 aa, Homo sapiens
YLDLFGDPS

SEQ ID NO: 9736 - protein, 11 aa, Homo sapiens
YLDLFGDPSVT

SEQ ID NO: 9737 - protein, 12 aa, Homo sapiens
YLDLFGDPSVTG

SEQ ID NO: 9738 - protein, 9 aa, Homo sapiens
YLDNGNNKM

SEQ ID NO: 9739 - protein, 9 aa, Homo sapiens
YLDNLVKHL

SEQ ID NO: 9740 - protein, 9 aa, Homo sapiens
YLDPRITVA

SEQ ID NO: 9741 - protein, 10 aa, Homo sapiens
YLDQISRYYI

SEQ ID NO: 9742 - protein, 9 aa, Homo sapiens
YLDQLNHIL

SEQ ID NO: 9743 - protein, 12 aa, Homo sapiens
YLDQTVVPILLQ

SEQ ID NO: 9744 - protein, 9 aa, Homo sapiens
YLDSEQRLM

SEQ ID NO: 9745 - protein, 9 aa, Homo sapiens
YLDVGLWHL

SEQ ID NO: 9746 - protein, 9 aa, Homo sapiens
YLEAGGTKV

SEQ ID NO: 9747 - protein, 11 aa, Homo sapiens
YLEDKPSPPPV

SEQ ID NO: 9748 - protein, 9 aa, Homo sapiens
YLEDKVYLT

SEQ ID NO: 9749 - protein, 11 aa, Homo sapiens
YLEDTKEKVSI

SEQ ID NO: 9750 - protein, 8 aa, Homo sapiens
YLEDVRLV

SEQ ID NO: 9751 - protein, 9 aa, Homo sapiens
YLEEDVYQL

SEQ ID NO: 9752 - protein, 12 aa, Homo sapiens
YLEEDVYQLQEL

SEQ ID NO: 9753 - protein, 11 aa, Homo sapiens
YLELDTIKNLV

SEQ ID NO: 9754 - protein, 10 aa, Homo sapiens
YLELFGDPSV

SEQ ID NO: 9755 - protein, 10 aa, Homo sapiens
YLENGTPDTA

SEQ ID NO: 9756 - protein, 9 aa, Homo sapiens
YLENMVIKL

SEQ ID NO: 9757 - protein, 10 aa, Homo sapiens
YLENYDAIRV

SEQ ID NO: 9758 - protein, 9 aa, Homo sapiens
YLESNGIKV

SEQ ID NO: 9759 - protein, 10 aa, Homo sapiens
YLFDDPLSAV

SEQ ID NO: 9760 - protein, 12 aa, Homo sapiens
YLFDEIDQALDA

SEQ ID NO: 9761 - protein, 8 aa, Homo sapiens
YLFDSFFS

SEQ ID NO: 9762 - protein, 9 aa, Homo sapiens
YLFDSFFSL

SEQ ID NO: 9763 - protein, 10 aa, Homo sapiens
YLFDSFFSLI

SEQ ID NO: 9764 - protein, 11 aa, Homo sapiens
YLFDVQRNNIA

SEQ ID NO: 9765 - protein, 12 aa, Homo sapiens
YLFEEGYTNKGM

SEQ ID NO: 9766 - protein, 9 aa, Homo sapiens
YLFENVDNA

SEQ ID NO: 9767 - protein, 9 aa, Homo sapiens
YLFEPVAKA

SEQ ID NO: 9768 - protein, 9 aa, Homo sapiens
YLFFDLPHV

SEQ ID NO: 9769 - protein, 9 aa, Homo sapiens
YLFGCELKA

SEQ ID NO: 9770 - protein, 10 aa, Homo sapiens
YLFGCELKAD

SEQ ID NO: 9771 - protein, 10 aa, Homo sapiens
YLFITPPKTV

SEQ ID NO: 9772 - protein, 12 aa, Homo sapiens
YLFNIMDTPGHV

SEQ ID NO: 9773 - protein, 10 aa, Homo sapiens
YLFQYPVRPA

SEQ ID NO: 9774 - protein, 9 aa, Homo sapiens
YLFSGFQEA

SEQ ID NO: 9775 - protein, 9 aa, Homo sapiens
YLFYDGESV

SEQ ID NO: 9776 - protein, 11 aa, Homo sapiens
YLGDDRNIEEV

SEQ ID NO: 9777 - protein, 10 aa, Homo sapiens
YLGDFIEHYA

SEQ ID NO: 9778 - protein, 11 aa, Homo sapiens
YLGDFIEHYAQ

SEQ ID NO: 9779 - protein, 12 aa, Homo sapiens
YLGDFIEHYAQL

SEQ ID NO: 9780 - protein, 8 aa, Homo sapiens
YLGEEYPE

SEQ ID NO: 9781 - protein, 9 aa, Homo sapiens
YLGEEYPEV

SEQ ID NO: 9782 - protein, 9 aa, Homo sapiens
YLGEEYVKA

SEQ ID NO: 9783 - protein, 10 aa, Homo sapiens
YLGEEYVKAV

SEQ ID NO: 9784 - protein, 11 aa, Homo sapiens
YLGGLPEPMAV

SEQ ID NO: 9785 - protein, 9 aa, Homo sapiens
YLGKKVTHA

SEQ ID NO: 9786 - protein, 11 aa, Homo sapiens
YLGKKVTHAVV

SEQ ID NO: 9787 - protein, 9 aa, Homo sapiens
YLGKTVTNA

SEQ ID NO: 9788 - protein, 11 aa, Homo sapiens
YLGKTVTNAVV

SEQ ID NO: 9789 - protein, 10 aa, Homo sapiens
YLGLLENLRV

SEQ ID NO: 9790 - protein, 8 aa, Homo sapiens
YLGLPAFL

SEQ ID NO: 9791 - protein, 9 aa, Homo sapiens
YLGLPAFLL

SEQ ID NO: 9792 - protein, 9 aa, Homo sapiens
YLGPDTPAL

SEQ ID NO: 9793 - protein, 11 aa, Homo sapiens
YLGQDYEQLRV

SEQ ID NO: 9794 - protein, 9 aa, Homo sapiens
YLGSRPVKL

SEQ ID NO: 9795 - protein, 11 aa, Homo sapiens
YLGYFLPAEFL

SEQ ID NO: 9796 - protein, 9 aa, Homo sapiens
YLGYPVTNA

SEQ ID NO: 9797 - protein, 12 aa, Homo sapiens
YLHEEFPESWSV

SEQ ID NO: 9798 - protein, 11 aa, Homo sapiens
YLHESTQDELA

SEQ ID NO: 9799 - protein, 10 aa, Homo sapiens
YLIDIKTIAI

SEQ ID NO: 9800 - protein, 10 aa, Homo sapiens
YLIEEIGDVL

SEQ ID NO: 9801 - protein, 11 aa, Homo sapiens
YLIEEIGDVLL

SEQ ID NO: 9802 - protein, 12 aa, Homo sapiens
YLIEEIGDVLLA

SEQ ID NO: 9803 - protein, 11 aa, Homo sapiens
YLIEIAKNYNV

SEQ ID NO: 9804 - protein, 11 aa, Homo sapiens
YLIPLLERLDL

SEQ ID NO: 9805 - protein, 11 aa, Homo sapiens
YLIPNATQPES

SEQ ID NO: 9806 - protein, 9 aa, Homo sapiens
YLKEAVTTL

SEQ ID NO: 9807 - protein, 9 aa, Homo sapiens
YLKEFIHIL

SEQ ID NO: 9808 - protein, 9 aa, Homo sapiens
YLKELLNLA

SEQ ID NO: 9809 - protein, 11 aa, Homo sapiens
YLKNDNPEEHL

SEQ ID NO: 9810 - protein, 9 aa, Homo sapiens
YLKQVIDVL

SEQ ID NO: 9811 - protein, 9 aa, Homo sapiens
YLLDPSITL

SEQ ID NO: 9812 - protein, 9 aa, Homo sapiens
YLLDYPNNL

SEQ ID NO: 9813 - protein, 10 aa, Homo sapiens
YLLDYPNNLL

SEQ ID NO: 9814 - protein, 10 aa, Homo sapiens
YLLDYPNNVL

SEQ ID NO: 9815 - protein, 10 aa, Homo sapiens
YLLEHLHPFL

SEQ ID NO: 9816 - protein, 12 aa, Homo sapiens
YLLGDALLVHPV

SEQ ID NO: 9817 - protein, 10 aa, Homo sapiens
YLLGELGEAL

SEQ ID NO: 9818 - protein, 12 aa, Homo sapiens
YLLGELGEALRM

SEQ ID NO: 9819 - protein, 10 aa, Homo sapiens
YLLGLGPLEV

SEQ ID NO: 9820 - protein, 12 aa, Homo sapiens
YLLGVADLTGEL

SEQ ID NO: 9821 - protein, 11 aa, Homo sapiens
YLLKDKGEYTL

SEQ ID NO: 9822 - protein, 12 aa, Homo sapiens
YLLLEETEKQAV

SEQ ID NO: 9823 - protein, 9 aa, Homo sapiens
YLLLYLHSV

SEQ ID NO: 9824 - protein, 8 aa, Homo sapiens
YLLPAIVH

SEQ ID NO: 9825 - protein, 9 aa, Homo sapiens
YLLPESVDL

SEQ ID NO: 9826 - protein, 11 aa, Homo sapiens
YLLPQQPPPSL

SEQ ID NO: 9827 - protein, 10 aa, Homo sapiens
YLLQTNPTYL

SEQ ID NO: 9828 - protein, 11 aa, Homo sapiens
YLLQTNPTYLA

SEQ ID NO: 9829 - protein, 10 aa, Homo sapiens
YLLQTQPIYL

SEQ ID NO: 9830 - protein, 9 aa, Homo sapiens
YLLSYIQSI

SEQ ID NO: 9831 - protein, 12 aa, Homo sapiens
YLMAISDKDQQL

SEQ ID NO: 9832 - protein, 9 aa, Homo sapiens
YLMDEGAHL

SEQ ID NO: 9833 - protein, 9 aa, Homo sapiens
YLMDLTHLI

SEQ ID NO: 9834 - protein, 10 aa, Homo sapiens
YLMDLTHLIL

SEQ ID NO: 9835 - protein, 10 aa, Homo sapiens
YLMDTSGKVV

SEQ ID NO: 9836 - protein, 11 aa, Homo sapiens
YLMDTSGKVVT

SEQ ID NO: 9837 - protein, 11 aa, Homo sapiens
YLMEEDEDAYK

SEQ ID NO: 9838 - protein, 12 aa, Homo sapiens
YLMEEDEDAYKK

SEQ ID NO: 9839 - protein, 9 aa, Homo sapiens
YLMGERLGV

SEQ ID NO: 9840 - protein, 12 aa, Homo sapiens
YLMGERLGVHPL

SEQ ID NO: 9841 - protein, 9 aa, Homo sapiens
YLMQPSLQV

SEQ ID NO: 9842 - protein, 11 aa, Homo sapiens
YLNDEPPEGSM

SEQ ID NO: 9843 - protein, 10 aa, Homo sapiens
YLNEIKDSVV

SEQ ID NO: 9844 - protein, 9 aa, Homo sapiens
YLNENPLRA

SEQ ID NO: 9845 - protein, 12 aa, Homo sapiens
YLNEQGDRVYTL

SEQ ID NO: 9846 - protein, 11 aa, Homo sapiens
YLNEVAGKHGV

SEQ ID NO: 9847 - protein, 9 aa, Homo sapiens
YLNFFTKAT

SEQ ID NO: 9848 - protein, 9 aa, Homo sapiens
YLNHLEPPV

SEQ ID NO: 9849 - protein, 9 aa, Homo sapiens
YLNKHIQKV

SEQ ID NO: 9850 - protein, 9 aa, Homo sapiens
YLNSILQHA

SEQ ID NO: 9851 - protein, 11 aa, Homo sapiens
YLNTFEFMDKL

SEQ ID NO: 9852 - protein, 9 aa, Homo sapiens
YLNVQVKEL

SEQ ID NO: 9853 - protein, 10 aa, Homo sapiens
YLPDFRFTPF

SEQ ID NO: 9854 - protein, 9 aa, Homo sapiens
YLPEELAAL

SEQ ID NO: 9855 - protein, 9 aa, Homo sapiens
YLPFVLQEI

SEQ ID NO: 9856 - protein, 11 aa, Homo sapiens
YLPHYIPGVDP

SEQ ID NO: 9857 - protein, 9 aa, Homo sapiens
YLPLPTPKV

SEQ ID NO: 9858 - protein, 9 aa, Homo sapiens
YLPTKLAAV

SEQ ID NO: 9859 - protein, 9 aa, Homo sapiens
YLQAAIVRI

SEQ ID NO: 9860 - protein, 10 aa, Homo sapiens
YLQDGDLDVV

SEQ ID NO: 9861 - protein, 11 aa, Homo sapiens
YLQDLVEGMDF

SEQ ID NO: 9862 - protein, 10 aa, Homo sapiens
YLQEHAQEVV

SEQ ID NO: 9863 - protein, 11 aa, Homo sapiens
YLQEHAQEVVL

SEQ ID NO: 9864 - protein, 11 aa, Homo sapiens
YLQETYSKQVT

SEQ ID NO: 9865 - protein, 9 aa, Homo sapiens
YLQEVIDVL

SEQ ID NO: 9866 - protein, 10 aa, Homo sapiens
YLQEVIDVLE

SEQ ID NO: 9867 - protein, 11 aa, Homo sapiens
YLQEVIDVLET

SEQ ID NO: 9868 - protein, 12 aa, Homo sapiens
YLQEVIDVLETD

SEQ ID NO: 9869 - protein, 9 aa, Homo sapiens
YLQGSSVQL

SEQ ID NO: 9870 - protein, 9 aa, Homo sapiens
YLQHVQIRL

SEQ ID NO: 9871 - protein, 10 aa, Homo sapiens
YLQPLVAVQV

SEQ ID NO: 9872 - protein, 12 aa, Homo sapiens
YLRPETAQGIFL

SEQ ID NO: 9873 - protein, 11 aa, Homo sapiens
YLSDNIFTHFV

SEQ ID NO: 9874 - protein, 10 aa, Homo sapiens
YLSEDVFQHA

SEQ ID NO: 9875 - protein, 11 aa, Homo sapiens
YLSEVGDTQVV

SEQ ID NO: 9876 - protein, 9 aa, Homo sapiens
YLSGIAHFL

SEQ ID NO: 9877 - protein, 9 aa, Homo sapiens
YLSGYGVEL

SEQ ID NO: 9878 - protein, 10 aa, Homo sapiens
YLSGYGVELA

SEQ ID NO: 9879 - protein, 9 aa, Homo sapiens
YLSKLIPHA

SEQ ID NO: 9880 - protein, 9 aa, Homo sapiens
YLSSHIANV

SEQ ID NO: 9881 - protein, 10 aa, Homo sapiens
YLSTEDVPLA

SEQ ID NO: 9882 - protein, 9 aa, Homo sapiens
YLSTKNTIL

SEQ ID NO: 9883 - protein, 10 aa, Homo sapiens
YLTAEILELA

SEQ ID NO: 9884 - protein, 11 aa, Homo sapiens
YLTDDLEFLRA

SEQ ID NO: 9885 - protein, 9 aa, Homo sapiens
YLTGYNFTL

SEQ ID NO: 9886 - protein, 9 aa, Homo sapiens
YLTKEDLRV

SEQ ID NO: 9887 - protein, 10 aa, Homo sapiens
YLTNEGIAHL

SEQ ID NO: 9888 - protein, 9 aa, Homo sapiens
YLTQMDVKL

SEQ ID NO: 9889 - protein, 10 aa, Homo sapiens
YLTRVEVTEF

SEQ ID NO: 9890 - protein, 11 aa, Homo sapiens
YLVAEKVVVIT

SEQ ID NO: 9891 - protein, 11 aa, Homo sapiens
YLVDDSFSQAL

SEQ ID NO: 9892 - protein, 11 aa, Homo sapiens
YLVDLAGSEKV

SEQ ID NO: 9893 - protein, 10 aa, Homo sapiens
YLVGDELWVV

SEQ ID NO: 9894 - protein, 11 aa, Homo sapiens
YLVSVDGYMNM

SEQ ID NO: 9895 - protein, 9 aa, Homo sapiens
YLWCIEQTL

SEQ ID NO: 9896 - protein, 11 aa, Homo sapiens
YLWDLDHGFAG

SEQ ID NO: 9897 - protein, 8 aa, Homo sapiens
YLWSEVFS

SEQ ID NO: 9898 - protein, 9 aa, Homo sapiens
YLWSEVFSM

SEQ ID NO: 9899 - protein, 10 aa, Homo sapiens
YLWSEVFSMD

SEQ ID NO: 9900 - protein, 8 aa, Homo sapiens
YLWSEVYS

SEQ ID NO: 9901 - protein, 9 aa, Homo sapiens
YLWSEVYSM

SEQ ID NO: 9902 - protein, 10 aa, Homo sapiens
YLWSEVYSMD

SEQ ID NO: 9903 - protein, 11 aa, Homo sapiens
YLWSEVYSMDM

SEQ ID NO: 9904 - protein, 12 aa, Homo sapiens
YLYGDDRIEPYI

SEQ ID NO: 9905 - protein, 11 aa, Homo sapiens
YLYGTGSVAGV

SEQ ID NO: 9906 - protein, 12 aa, Homo sapiens
YLYKQPAEHLQL

SEQ ID NO: 9907 - protein, 10 aa, Homo sapiens
YLYNNLPHHV

SEQ ID NO: 9908 - protein, 12 aa, Homo sapiens
YLYQEGNNGPHL

SEQ ID NO: 9909 - protein, 12 aa, Homo sapiens
YMAGIDGEKEHA

SEQ ID NO: 9910 - protein, 9 aa, Homo sapiens
YMDENRNIT

SEQ ID NO: 9911 - protein, 10 aa, Homo sapiens
YMDENRNITF

SEQ ID NO: 9912 - protein, 9 aa, Homo sapiens
YMDNDYAKL

SEQ ID NO: 9913 - protein, 9 aa, Homo sapiens
YMEEVKEEV

SEQ ID NO: 9914 - protein, 9 aa, Homo sapiens
YMFEEHEMI

SEQ ID NO: 9915 - protein, 10 aa, Homo sapiens
YMFGKGIYFA

SEQ ID NO: 9916 - protein, 10 aa, Homo sapiens
YMGEEHLFSV

SEQ ID NO: 9917 - protein, 9 aa, Homo sapiens
YMHSGPVVA

SEQ ID NO: 9918 - protein, 10 aa, Homo sapiens
YMHSGPVVAM

SEQ ID NO: 9919 - protein, 9 aa, Homo sapiens
YMINFIHKL

SEQ ID NO: 9920 - protein, 9 aa, Homo sapiens
YMNGHSDVV

SEQ ID NO: 9921 - protein, 10 aa, Homo sapiens
YMNGHSDVVM

SEQ ID NO: 9922 - protein, 9 aa, Homo sapiens
YMNSGPVVA

SEQ ID NO: 9923 - protein, 10 aa, Homo sapiens
YMNSGPVVAM

SEQ ID NO: 9924 - protein, 9 aa, Homo sapiens
YMSSTDAKV

SEQ ID NO: 9925 - protein, 9 aa, Homo sapiens
YMVGPIEEA

SEQ ID NO: 9926 - protein, 11 aa, Homo sapiens
YQDELTALLRL

SEQ ID NO: 9927 - protein, 9 aa, Homo sapiens
YQDPHSTAV

SEQ ID NO: 9928 - protein, 11 aa, Homo sapiens
YQDPLDPTRSV

SEQ ID NO: 9929 - protein, 9 aa, Homo sapiens
YQEFTDHLV

SEQ ID NO: 9930 - protein, 9 aa, Homo sapiens
YQIAEQFRV

SEQ ID NO: 9931 - protein, 10 aa, Homo sapiens
YQIKGLEWLV

SEQ ID NO: 9932 - protein, 11 aa, Homo sapiens
YQLEIPENFTT

SEQ ID NO: 9933 - protein, 10 aa, Homo sapiens
YQNEDEKVTL

SEQ ID NO: 9934 - protein, 11 aa, Homo sapiens
YQQCINEAQRV

SEQ ID NO: 9935 - protein, 11 aa, Homo sapiens
YSATEETLQEV

SEQ ID NO: 9936 - protein, 10 aa, Homo sapiens
YSDNEMPPEA

SEQ ID NO: 9937 - protein, 9 aa, Homo sapiens
YTDDANQEV

SEQ ID NO: 9938 - protein, 9 aa, Homo sapiens
YTDKVVIGM

SEQ ID NO: 9939 - protein, 11 aa, Homo sapiens
YTDKVVIGMDV

SEQ ID NO: 9940 - protein, 9 aa, Homo sapiens
YTLGVKQLI

SEQ ID NO: 9941 - protein, 9 aa, Homo sapiens
YTSNIPIIL

SEQ ID NO: 9942 - protein, 10 aa, Homo sapiens
YTYEELLNRV

SEQ ID NO: 9943 - protein, 11 aa, Homo sapiens
YVDDGLISLQV

SEQ ID NO: 9944 - protein, 10 aa, Homo sapiens
YVDDTPAEQM

SEQ ID NO: 9945 - protein, 9 aa, Homo sapiens
YVDGDPHFI

SEQ ID NO: 9946 - protein, 9 aa, Homo sapiens
YVDPVITSI

SEQ ID NO: 9947 - protein, 10 aa, Homo sapiens
YVFDGKPPQL

SEQ ID NO: 9948 - protein, 9 aa, Homo sapiens
YVFENTVAT

SEQ ID NO: 9949 - protein, 10 aa, Homo sapiens
YVIEDDVNMA

SEQ ID NO: 9950 - protein, 11 aa, Homo sapiens
YVIEDDVNMAI

SEQ ID NO: 9951 - protein, 12 aa, Homo sapiens
YVINLDPAVHEV

SEQ ID NO: 9952 - protein, 9 aa, Homo sapiens
YVIYKVPQV

SEQ ID NO: 9953 - protein, 9 aa, Homo sapiens
YVQELLEKA

SEQ ID NO: 9954 - protein, 10 aa, Homo sapiens
YVVDLDDEYA

SEQ ID NO: 9955 - protein, 12 aa, Homo sapiens
YVYGEDMTPTLL

SEQ ID NO: 9956 - protein, 9 aa, Homo sapiens
AISESNINL

SEQ ID NO: 9957 - protein, 9 aa, Homo sapiens
ALDNGLFTL

SEQ ID NO: 9958 - protein, 10 aa, Homo sapiens
ALGGHPLLGV

SEQ ID NO: 9959 - protein, 12 aa, Homo sapiens
ALQDIGKNIYTI

SEQ ID NO: 9960 - protein, 9 aa, Homo sapiens
ALSEELVQL

SEQ ID NO: 9961 - protein, 9 aa, Homo sapiens
ALSSLAVVV

SEQ ID NO: 9962 - protein, 10 aa, Homo sapiens
ALWKEPGSNV

SEQ ID NO: 9963 - protein, 9 aa, Homo sapiens
AQHKFLVAV

SEQ ID NO: 9964 - protein, 9 aa, Homo sapiens
AQYLINVRL

SEQ ID NO: 9965 - protein, 9 aa, Homo sapiens
AQYLLQNSV

SEQ ID NO: 9966 - protein, 9 aa, Homo sapiens
AVGLAVLNV

SEQ ID NO: 9967 - protein, 9 aa, Homo sapiens
AVSNHVFHL

SEQ ID NO: 9968 - protein, 12 aa, Toxoplasma gondii ME49
DNIQGITKPAIR

SEQ ID NO: 9969 - protein, 10 aa, Homo sapiens
ELFPHSLLSV

SEQ ID NO: 9970 - protein, 9 aa, Homo sapiens
EVISKLYAV

SEQ ID NO: 9971 - protein, 9 aa, Homo sapiens
FASEVSNVL

SEQ ID NO: 9972 - protein, 10 aa, Homo sapiens
FIDKFTPPVV

SEQ ID NO: 9973 - protein, 9 aa, Homo sapiens
FLDGYVSQL

SEQ ID NO: 9974 - protein, 9 aa, Homo sapiens
FLSAIVSSV

SEQ ID NO: 9975 - protein, 9 aa, Homo sapiens
FLSHIPITL

SEQ ID NO: 9976 - protein, 9 aa, Homo sapiens
FVKDSIRLV

SEQ ID NO: 9977 - protein, 9 aa, Homo sapiens
GLAPQIHDL

SEQ ID NO: 9978 - protein, 9 aa, Homo sapiens
GLDGPPPTV

SEQ ID NO: 9979 - protein, 11 aa, Homo sapiens
GLIPIHADPRL

SEQ ID NO: 9980 - protein, 11 aa, Homo sapiens
GLLGAGGTVSV

SEQ ID NO: 9981 - protein, 9 aa, Homo sapiens
GLMRKVPRV

SEQ ID NO: 9982 - protein, 9 aa, Homo sapiens
GLNEHNHHL

SEQ ID NO: 9983 - protein, 9 aa, Homo sapiens
GLSPEIHTL

SEQ ID NO: 9984 - protein, 9 aa, Homo sapiens
GLWDKFSEL

SEQ ID NO: 9985 - protein, 9 aa, Homo sapiens
HIMPTVHTV

SEQ ID NO: 9986 - protein, 9 aa, Homo sapiens
HLFNVAHTL

SEQ ID NO: 9987 - protein, 9 aa, Homo sapiens
HLINFSETL

SEQ ID NO: 9988 - protein, 9 aa, Homo sapiens
HLLGDQISL

SEQ ID NO: 9989 - protein, 9 aa, Homo sapiens
HLQDKIQKL

SEQ ID NO: 9990 - protein, 9 aa, Homo sapiens
HLVPEVPTV

SEQ ID NO: 9991 - protein, 9 aa, Homo sapiens
HQLPLPHNV

SEQ ID NO: 9992 - protein, 11 aa, Homo sapiens
ILLEHGADPNL

SEQ ID NO: 9993 - protein, 10 aa, Homo sapiens
ILMEHIHKLK

SEQ ID NO: 9994 - protein, 9 aa, Homo sapiens
ILQERIPWV

SEQ ID NO: 9995 - protein, 9 aa, Homo sapiens
IQYIRPVFV

SEQ ID NO: 9996 - protein, 9 aa, Homo sapiens
KIIDIQEKV

SEQ ID NO: 9997 - protein, 9 aa, Homo sapiens
KIQPALQEK

SEQ ID NO: 9998 - protein, 10 aa, Homo sapiens
KLADIQIEQL

SEQ ID NO: 9999 - protein, 10 aa, Homo sapiens
KLDEYIAIAK

SEQ ID NO: 10000 - protein, 11 aa, Homo sapiens
KLFPKGTIFTA

SEQ ID NO: 10001 - protein, 9 aa, Homo sapiens
KLIDPQTQV

SEQ ID NO: 10002 - protein, 9 aa, Homo sapiens
KLIEYYQQL

SEQ ID NO: 10003 - protein, 11 aa, Homo sapiens
KLLDLKKQLAV

SEQ ID NO: 10004 - protein, 10 aa, Homo sapiens
KLPDLPQNSV

SEQ ID NO: 10005 - protein, 9 aa, Homo sapiens
KLPTPTSSV

SEQ ID NO: 10006 - protein, 9 aa, Homo sapiens
KLREDLERL

SEQ ID NO: 10007 - protein, 10 aa, Homo sapiens
KLYEKKLLKL

SEQ ID NO: 10008 - protein, 10 aa, Homo sapiens
KLYSSEQLLI

SEQ ID NO: 10009 - protein, 9 aa, Homo sapiens
KMAPALRKV

SEQ ID NO: 10010 - protein, 9 aa, Homo sapiens
KTKDGVREV

SEQ ID NO: 10011 - protein, 11 aa, Homo sapiens
KTLQPSSQNTK

SEQ ID NO: 10012 - protein, 9 aa, Homo sapiens
KVIDTQQKV

SEQ ID NO: 10013 - protein, 11 aa, Homo sapiens
KVLRESGLKYV

SEQ ID NO: 10014 - protein, 9 aa, Homo sapiens
LLDEPTNML

SEQ ID NO: 10015 - protein, 9 aa, Homo sapiens
LLHSFVDSV

SEQ ID NO: 10016 - protein, 11 aa, Homo sapiens
LLLAAARLAAA

SEQ ID NO: 10017 - protein, 9 aa, Homo sapiens
LLLPGLETV

SEQ ID NO: 10018 - protein, 9 aa, Homo sapiens
LLLPGPSAA

SEQ ID NO: 10019 - protein, 10 aa, Homo sapiens
LLLPPPPCPA

SEQ ID NO: 10020 - protein, 9 aa, Homo sapiens
LLPSHPLEL

SEQ ID NO: 10021 - protein, 9 aa, Homo sapiens
LLYGHTVTV

SEQ ID NO: 10022 - protein, 9 aa, Homo sapiens
LQLDKEFQL

SEQ ID NO: 10023 - protein, 9 aa, Homo sapiens
LVTDIQPVL

SEQ ID NO: 10024 - protein, 9 aa, Homo sapiens
LYPEVFEKF

SEQ ID NO: 10025 - protein, 11 aa, Homo sapiens
NLAGENILNPL

SEQ ID NO: 10026 - protein, 9 aa, Homo sapiens
QLDETNALL

SEQ ID NO: 10027 - protein, 10 aa, Homo sapiens
QLHAGSLVSV

SEQ ID NO: 10028 - protein, 9 aa, Homo sapiens
QLIEKNWLL

SEQ ID NO: 10029 - protein, 9 aa, Homo sapiens
QLNEKVAQL

SEQ ID NO: 10030 - protein, 9 aa, Homo sapiens
QLTEMLPSI

SEQ ID NO: 10031 - protein, 11 aa, Homo sapiens
RIAGIRGIQGV

SEQ ID NO: 10032 - protein, 11 aa, Homo sapiens
RLAEALPKQSV

SEQ ID NO: 10033 - protein, 12 aa, Homo sapiens
RLIGELAKEIRK

SEQ ID NO: 10034 - protein, 9 aa, Homo sapiens
RLLSKIHNV

SEQ ID NO: 10035 - protein, 9 aa, Homo sapiens
RLNKVIKSV

SEQ ID NO: 10036 - protein, 9 aa, Homo sapiens
RLQSKTIKV

SEQ ID NO: 10037 - protein, 10 aa, Homo sapiens
RLYDGLFKVI

SEQ ID NO: 10038 - protein, 10 aa, Homo sapiens
RMVDMPANNK

SEQ ID NO: 10039 - protein, 11 aa, Homo sapiens
RVIDDSLVVGV

SEQ ID NO: 10040 - protein, 9 aa, Homo sapiens
RYLDEINLL

SEQ ID NO: 10041 - protein, 9 aa, Homo sapiens
SAVGHVFSL

SEQ ID NO: 10042 - protein, 9 aa, Homo sapiens
SISDVIAQV

SEQ ID NO: 10043 - protein, 9 aa, Homo sapiens
SLADLNSRL

SEQ ID NO: 10044 - protein, 10 aa, Homo sapiens
SLADVDPMQL

SEQ ID NO: 10045 - protein, 9 aa, Homo sapiens
SLAERVDRL

SEQ ID NO: 10046 - protein, 9 aa, Homo sapiens
SLDTQPKKV

SEQ ID NO: 10047 - protein, 10 aa, Homo sapiens
SLEGIPLAQV

SEQ ID NO: 10048 - protein, 9 aa, Homo sapiens
SLITPLQAV

SEQ ID NO: 10049 - protein, 9 aa, Homo sapiens
SLLAANNLL

SEQ ID NO: 10050 - protein, 10 aa, Homo sapiens
SLLEQGLVEA

SEQ ID NO: 10051 - protein, 10 aa, Homo sapiens
SLLGTENASV

SEQ ID NO: 10052 - protein, 9 aa, Homo sapiens
SLLPAQYNL

SEQ ID NO: 10053 - protein, 9 aa, Homo sapiens
SLLPSVPAL

SEQ ID NO: 10054 - protein, 9 aa, Homo sapiens
SLSAFTPAL

SEQ ID NO: 10055 - protein, 9 aa, Homo sapiens
SLSFVSPSL

SEQ ID NO: 10056 - protein, 9 aa, Homo sapiens
SLVATLQSV

SEQ ID NO: 10057 - protein, 11 aa, Homo sapiens
SLYDQAEKLVS

SEQ ID NO: 10058 - protein, 9 aa, Homo sapiens
SMNTHLKAV

SEQ ID NO: 10059 - protein, 9 aa, Homo sapiens
SVASTITGV

SEQ ID NO: 10060 - protein, 9 aa, Homo sapiens
SVLKSIQEV

SEQ ID NO: 10061 - protein, 9 aa, Homo sapiens
SVYGKLRKV

SEQ ID NO: 10062 - protein, 9 aa, Homo sapiens
TLAFVSPSL

SEQ ID NO: 10063 - protein, 9 aa, Homo sapiens
TLKDTITSV

SEQ ID NO: 10064 - protein, 10 aa, Homo sapiens
TLSDGVVVQV

SEQ ID NO: 10065 - protein, 9 aa, Homo sapiens
TLSQVIPMV

SEQ ID NO: 10066 - protein, 9 aa, Homo sapiens
TLTGKTITL

SEQ ID NO: 10067 - protein, 9 aa, Homo sapiens
TLTNIIHNL

SEQ ID NO: 10068 - protein, 9 aa, Homo sapiens
TLTSNIPEI

SEQ ID NO: 10069 - protein, 9 aa, Homo sapiens
TVPPVFVSV

SEQ ID NO: 10070 - protein, 10 aa, Homo sapiens
VINDVRDIFL

SEQ ID NO: 10071 - protein, 9 aa, Homo sapiens
VLAELPQQV

SEQ ID NO: 10072 - protein, 9 aa, Homo sapiens
VLWPESISV

SEQ ID NO: 10073 - protein, 9 aa, Homo sapiens
VMAGDIYSV

SEQ ID NO: 10074 - protein, 9 aa, Homo sapiens
VQIGDIVTV

SEQ ID NO: 10075 - protein, 9 aa, Homo sapiens
VQVPVPVTV

SEQ ID NO: 10076 - protein, 9 aa, Homo sapiens
VQYAYFKKV

SEQ ID NO: 10077 - protein, 9 aa, Homo sapiens
VQYNEPLKV

SEQ ID NO: 10078 - protein, 9 aa, Homo sapiens
VTDHNLHEL

SEQ ID NO: 10079 - protein, 9 aa, Homo sapiens
VVVDPIQSV

SEQ ID NO: 10080 - protein, 9 aa, Homo sapiens
VVVGDLVEV

SEQ ID NO: 10081 - protein, 9 aa, Homo sapiens
YINPVSSAV

SEQ ID NO: 10082 - protein, 9 aa, Homo sapiens
YLEPKLTQV

SEQ ID NO: 10083 - protein, 10 aa, Homo sapiens
AALKKALAAA

SEQ ID NO: 10084 - protein, 10 aa, Homo sapiens
AGQAFRKFLP

SEQ ID NO: 10085 - protein, 10 aa, Homo sapiens
AGWNAYIDNL

SEQ ID NO: 10086 - protein, 9 aa, Homo sapiens
ALAKAPFAA

SEQ ID NO: 10087 - protein, 9 aa, Homo sapiens
ALAKHLIKI

SEQ ID NO: 10088 - protein, 9 aa, Homo sapiens
ALARLVLRL

SEQ ID NO: 10089 - protein, 9 aa, Homo sapiens
ALLNVELEL

SEQ ID NO: 10090 - protein, 12 aa, Homo sapiens
ALLYEDALYTVL

SEQ ID NO: 10091 - protein, 10 aa, Homo sapiens
ALQEACEAYL

SEQ ID NO: 10092 - protein, 9 aa, Homo sapiens
AVCPLVVRL

SEQ ID NO: 10093 - protein, 9 aa, Homo sapiens
DLLQIPPEL

SEQ ID NO: 10094 - protein, 9 aa, Homo sapiens
EMLQQVTQL

SEQ ID NO: 10095 - protein, 9 aa, Homo sapiens
EPSVPVQPL

SEQ ID NO: 10096 - protein, 8 aa, Homo sapiens
FADKVPKT

SEQ ID NO: 10097 - protein, 9 aa, Homo sapiens
FADKVPKTA

SEQ ID NO: 10098 - protein, 10 aa, Homo sapiens
FADKVPKTAE

SEQ ID NO: 10099 - protein, 8 aa, Homo sapiens
FGGHIRSV

SEQ ID NO: 10100 - protein, 9 aa, Homo sapiens
FIADHCPTL

SEQ ID NO: 10101 - protein, 10 aa, Homo sapiens
FIASKGVKLV

SEQ ID NO: 10102 - protein, 9 aa, Homo sapiens
FILAAIYHL

SEQ ID NO: 10103 - protein, 11 aa, Homo sapiens
FILPTLVPWYF

SEQ ID NO: 10104 - protein, 9 aa, Homo sapiens
FLAPLLAKL

SEQ ID NO: 10105 - protein, 10 aa, Homo sapiens
FLFDHQLVSC

SEQ ID NO: 10106 - protein, 9 aa, Homo sapiens
FLFSDVCRV

SEQ ID NO: 10107 - protein, 9 aa, Homo sapiens
FLHQQPANC

SEQ ID NO: 10108 - protein, 9 aa, Homo sapiens
FLHRLPILL

SEQ ID NO: 10109 - protein, 9 aa, Homo sapiens
FLLHQKIAL

SEQ ID NO: 10110 - protein, 10 aa, Homo sapiens
FLLNLQNCHL

SEQ ID NO: 10111 - protein, 9 aa, Homo sapiens
FLLQQLPPV

SEQ ID NO: 10112 - protein, 9 aa, Homo sapiens
FLLTIENEL

SEQ ID NO: 10113 - protein, 9 aa, Homo sapiens
FLMKLQSLL

SEQ ID NO: 10114 - protein, 11 aa, Homo sapiens
FLQDTIEEMAL

SEQ ID NO: 10115 - protein, 9 aa, Homo sapiens
FLQRKLASL

SEQ ID NO: 10116 - protein, 10 aa, Homo sapiens
FLTDMPDILL

SEQ ID NO: 10117 - protein, 10 aa, Homo sapiens
FLYKEKLVSV

SEQ ID NO: 10118 - protein, 9 aa, Homo sapiens
FMDVKCPGC

SEQ ID NO: 10119 - protein, 9 aa, Homo sapiens
FMIKFPWKL

SEQ ID NO: 10120 - protein, 9 aa, Homo sapiens
FMSSHIKSV

SEQ ID NO: 10121 - protein, 9 aa, Homo sapiens
FVARMIPKV

SEQ ID NO: 10122 - protein, 11 aa, Homo sapiens
GIKEDTEEHHL

SEQ ID NO: 10123 - protein, 9 aa, Homo sapiens
GLADRCPAL

SEQ ID NO: 10124 - protein, 9 aa, Homo sapiens
GLAEKIRAC

SEQ ID NO: 10125 - protein, 9 aa, Homo sapiens
GLAKRVWSL

SEQ ID NO: 10126 - protein, 9 aa, Homo sapiens
GLCERLVSL

SEQ ID NO: 10127 - protein, 9 aa, Homo sapiens
GLCPHVVVL

SEQ ID NO: 10128 - protein, 11 aa, Homo sapiens
GLLDAAHFCYL

SEQ ID NO: 10129 - protein, 9 aa, Homo sapiens
GLLDRIMQL

SEQ ID NO: 10130 - protein, 9 aa, Homo sapiens
GLLEHILYC

SEQ ID NO: 10131 - protein, 10 aa, Homo sapiens
GLLGDIAIHL

SEQ ID NO: 10132 - protein, 9 aa, Homo sapiens
GLLRLAIRL

SEQ ID NO: 10133 - protein, 9 aa, Homo sapiens
GLLTRLLQV

SEQ ID NO: 10134 - protein, 9 aa, Homo sapiens
GLRTLGPAL

SEQ ID NO: 10135 - protein, 9 aa, Homo sapiens
GMMKELHKV

SEQ ID NO: 10136 - protein, 9 aa, Homo sapiens
HLCEHIWTL

SEQ ID NO: 10137 - protein, 9 aa, Homo sapiens
HLLHSKFHL

SEQ ID NO: 10138 - protein, 9 aa, Homo sapiens
HLLVHDVAL

SEQ ID NO: 10139 - protein, 9 aa, Homo sapiens
HMVEKTYEC

SEQ ID NO: 10140 - protein, 9 aa, Homo sapiens
IAVHVVPDQ

SEQ ID NO: 10141 - protein, 10 aa, Homo sapiens
IAVHVVPDQL

SEQ ID NO: 10142 - protein, 10 aa, Homo sapiens
IAYLKKATNE

SEQ ID NO: 10143 - protein, 9 aa, Homo sapiens
ILDVTVVYL

SEQ ID NO: 10144 - protein, 11 aa, Homo sapiens
ILLSEEDLQML

SEQ ID NO: 10145 - protein, 11 aa, Homo sapiens
ILLTSTELFQL

SEQ ID NO: 10146 - protein, 9 aa, Homo sapiens
ILPEKVARV

SEQ ID NO: 10147 - protein, 9 aa, Homo sapiens
ILVDWLVQV

SEQ ID NO: 10148 - protein, 9 aa, Homo sapiens
ILWSHLELL

SEQ ID NO: 10149 - protein, 12 aa, Homo sapiens
IVNTNVPRASVP

SEQ ID NO: 10150 - protein, 9 aa, Homo sapiens
KICDYLFNV

SEQ ID NO: 10151 - protein, 10 aa, Homo sapiens
KIGEHTPSAL

SEQ ID NO: 10152 - protein, 9 aa, Homo sapiens
KIIKIIITV

SEQ ID NO: 10153 - protein, 9 aa, Homo sapiens
KLCDIIVHI

SEQ ID NO: 10154 - protein, 9 aa, Homo sapiens
KLDSPRVTV

SEQ ID NO: 10155 - protein, 9 aa, Homo sapiens
KLIAKIPTI

SEQ ID NO: 10156 - protein, 10 aa, Homo sapiens
KLIGHGVKGV

SEQ ID NO: 10157 - protein, 9 aa, Homo sapiens
KLLARISKL

SEQ ID NO: 10158 - protein, 10 aa, Homo sapiens
KLLEFVPHHC

SEQ ID NO: 10159 - protein, 9 aa, Homo sapiens
KLLEREGAL

SEQ ID NO: 10160 - protein, 11 aa, Homo sapiens
KLLNHPHIIKL

SEQ ID NO: 10161 - protein, 10 aa, Homo sapiens
KLNEDMACSV

SEQ ID NO: 10162 - protein, 9 aa, Homo sapiens
KLWNKIWCI

SEQ ID NO: 10163 - protein, 11 aa, Homo sapiens
KLWPEASKVKV

SEQ ID NO: 10164 - protein, 9 aa, Homo sapiens
KVLNKVITV

SEQ ID NO: 10165 - protein, 8 aa, Homo sapiens
LFDRPMHV

SEQ ID NO: 10166 - protein, 9 aa, Homo sapiens
LLADLKTMV

SEQ ID NO: 10167 - protein, 9 aa, Homo sapiens
LLAPFCPHL

SEQ ID NO: 10168 - protein, 8 aa, Homo sapiens
LLGRRAPV

SEQ ID NO: 10169 - protein, 11 aa, Homo sapiens
LLKNSPLVSRL

SEQ ID NO: 10170 - protein, 12 aa, Homo sapiens
LLKNSPLVSRLT

SEQ ID NO: 10171 - protein, 9 aa, Homo sapiens
LLLPLPVPA

SEQ ID NO: 10172 - protein, 9 aa, Homo sapiens
LLSSHVRGV

SEQ ID NO: 10173 - protein, 9 aa, Homo sapiens
LLYRYMHFL

SEQ ID NO: 10174 - protein, 10 aa, Homo sapiens
LMEHIHKLKA

SEQ ID NO: 10175 - protein, 9 aa, Homo sapiens
LMYDGTKEV

SEQ ID NO: 10176 - protein, 9 aa, Homo sapiens
LSMKTLQLL

SEQ ID NO: 10177 - protein, 9 aa, Homo sapiens
LVKELRTVV

SEQ ID NO: 10178 - protein, 9 aa, Homo sapiens
LVRPEVDVM

SEQ ID NO: 10179 - protein, 9 aa, Homo sapiens
MEHIHKLKA

SEQ ID NO: 10180 - protein, 9 aa, Homo sapiens
MLDEILLQL

SEQ ID NO: 10181 - protein, 9 aa, Homo sapiens
NCPERIITL

SEQ ID NO: 10182 - protein, 11 aa, Homo sapiens
NLASFIEQVAV

SEQ ID NO: 10183 - protein, 9 aa, Homo sapiens
NLCPTRIEV

SEQ ID NO: 10184 - protein, 10 aa, Homo sapiens
NLYSKMLAKV

SEQ ID NO: 10185 - protein, 9 aa, Homo sapiens
QIMEYIHKI

SEQ ID NO: 10186 - protein, 9 aa, Homo sapiens
QIVERVIAV

SEQ ID NO: 10187 - protein, 9 aa, Homo sapiens
QLCDLETKL

SEQ ID NO: 10188 - protein, 9 aa, Homo sapiens
QLCEDIIQL

SEQ ID NO: 10189 - protein, 9 aa, Homo sapiens
QLIKHAVYL

SEQ ID NO: 10190 - protein, 9 aa, Homo sapiens
QLLALLPSL

SEQ ID NO: 10191 - protein, 9 aa, Homo sapiens
QLLDVIHYV

SEQ ID NO: 10192 - protein, 9 aa, Homo sapiens
QLLELPLNL

SEQ ID NO: 10193 - protein, 11 aa, Homo sapiens
QLLETISQLYL

SEQ ID NO: 10194 - protein, 9 aa, Homo sapiens
QLLETLNQL

SEQ ID NO: 10195 - protein, 9 aa, Homo sapiens
QLLKFIPGL

SEQ ID NO: 10196 - protein, 9 aa, Homo sapiens
QLLKSLPEL

SEQ ID NO: 10197 - protein, 9 aa, Homo sapiens
QLLSEITRV

SEQ ID NO: 10198 - protein, 9 aa, Homo sapiens
QLMERNPEI

SEQ ID NO: 10199 - protein, 9 aa, Homo sapiens
QLMNLIRSV

SEQ ID NO: 10200 - protein, 9 aa, Homo sapiens
QLMPLPVKV

SEQ ID NO: 10201 - protein, 9 aa, Homo sapiens
QLNHYVKAV

SEQ ID NO: 10202 - protein, 9 aa, Homo sapiens
QLSTVITQV

SEQ ID NO: 10203 - protein, 9 aa, Homo sapiens
QLYLKLWNL

SEQ ID NO: 10204 - protein, 9 aa, Homo sapiens
QLYNSLIFL

SEQ ID NO: 10205 - protein, 9 aa, Homo sapiens
QMCGLHIVV

SEQ ID NO: 10206 - protein, 9 aa, Homo sapiens
QVCAIIERV

SEQ ID NO: 10207 - protein, 10 aa, Homo sapiens
QVMPGNIVFV

SEQ ID NO: 10208 - protein, 9 aa, Homo sapiens
QVVAIVHAV

SEQ ID NO: 10209 - protein, 9 aa, Homo sapiens
RIYKYIHKV

SEQ ID NO: 10210 - protein, 9 aa, Homo sapiens
RLCGLKVEV

SEQ ID NO: 10211 - protein, 9 aa, Homo sapiens
RLFRVFVHV

SEQ ID NO: 10212 - protein, 9 aa, Homo sapiens
RLKDEIAEV

SEQ ID NO: 10213 - protein, 9 aa, Homo sapiens
RLMKHDVNL

SEQ ID NO: 10214 - protein, 9 aa, Homo sapiens
RLVDLDWRV

SEQ ID NO: 10215 - protein, 9 aa, Homo sapiens
RMFPGEVAL

SEQ ID NO: 10216 - protein, 9 aa, Homo sapiens
RMLDVLEYI

SEQ ID NO: 10217 - protein, 9 aa, Homo sapiens
RMLHFLTAV

SEQ ID NO: 10218 - protein, 9 aa, Homo sapiens
RMLIKLLEV

SEQ ID NO: 10219 - protein, 9 aa, Homo sapiens
RMVHILTSV

SEQ ID NO: 10220 - protein, 9 aa, Homo sapiens
SIAELVPKC

SEQ ID NO: 10221 - protein, 9 aa, Homo sapiens
SILRGIFSV

SEQ ID NO: 10222 - protein, 11 aa, Homo sapiens
SIQQSIERLLV

SEQ ID NO: 10223 - protein, 9 aa, Homo sapiens
SLADCIPLL

SEQ ID NO: 10224 - protein, 10 aa, Homo sapiens
SLAKHGIVAL

SEQ ID NO: 10225 - protein, 9 aa, Homo sapiens
SLFPHAICL

SEQ ID NO: 10226 - protein, 9 aa, Homo sapiens
SLFSAVHKI

SEQ ID NO: 10227 - protein, 9 aa, Homo sapiens
SLGSFICKL

SEQ ID NO: 10228 - protein, 9 aa, Homo sapiens
SLHSKLFRV

SEQ ID NO: 10229 - protein, 9 aa, Homo sapiens
SLIKHKIML

SEQ ID NO: 10230 - protein, 9 aa, Homo sapiens
SLLACEFLL

SEQ ID NO: 10231 - protein, 10 aa, Homo sapiens
SLLDHLLTEC

SEQ ID NO: 10232 - protein, 9 aa, Homo sapiens
SLLHMPFTI

SEQ ID NO: 10233 - protein, 9 aa, Homo sapiens
SLLRALERL

SEQ ID NO: 10234 - protein, 9 aa, Homo sapiens
SLLRHLEKV

SEQ ID NO: 10235 - protein, 9 aa, Homo sapiens
SLLRKIYEI

SEQ ID NO: 10236 - protein, 10 aa, Homo sapiens
SLSLLCIPAI

SEQ ID NO: 10237 - protein, 9 aa, Homo sapiens
SLSSLVVQL

SEQ ID NO: 10238 - protein, 9 aa, Homo sapiens
SLWSIISKV

SEQ ID NO: 10239 - protein, 9 aa, Homo sapiens
SLYHIYVAL

SEQ ID NO: 10240 - protein, 9 aa, Homo sapiens
SMHNVKLFL

SEQ ID NO: 10241 - protein, 9 aa, Homo sapiens
SMLGRVVKV

SEQ ID NO: 10242 - protein, 9 aa, Homo sapiens
TILEKCFKV

SEQ ID NO: 10243 - protein, 9 aa, Homo sapiens
TIMKKVTSV

SEQ ID NO: 10244 - protein, 10 aa, Homo sapiens
TIPDFIFANV

SEQ ID NO: 10245 - protein, 9 aa, Homo sapiens
TLAKLIAKI

SEQ ID NO: 10246 - protein, 10 aa, Homo sapiens
TLIAVVAVVA

SEQ ID NO: 10247 - protein, 9 aa, Homo sapiens
TLLGLSLQV

SEQ ID NO: 10248 - protein, 11 aa, Homo sapiens
TLLHAGGLARA

SEQ ID NO: 10249 - protein, 11 aa, Homo sapiens
TLMNLGGLAVA

SEQ ID NO: 10250 - protein, 11 aa, Homo sapiens
TLMPEKLSHKL

SEQ ID NO: 10251 - protein, 9 aa, Homo sapiens
TMLLNIPLV

SEQ ID NO: 10252 - protein, 10 aa, Homo sapiens
TVYGGYLCSV

SEQ ID NO: 10253 - protein, 9 aa, Homo sapiens
VAVEKVQLA

SEQ ID NO: 10254 - protein, 9 aa, Homo sapiens
VIWKALIHL

SEQ ID NO: 10255 - protein, 10 aa, Homo sapiens
VLAELKGVTC

SEQ ID NO: 10256 - protein, 9 aa, Homo sapiens
VLAPRVLRA

SEQ ID NO: 10257 - protein, 9 aa, Homo sapiens
VLDHNPPGC

SEQ ID NO: 10258 - protein, 10 aa, Homo sapiens
VLFDVSIMAV

SEQ ID NO: 10259 - protein, 10 aa, Homo sapiens
VLLHFKHIYL

SEQ ID NO: 10260 - protein, 9 aa, Homo sapiens
VLQYVVPEV

SEQ ID NO: 10261 - protein, 12 aa, Homo sapiens
VLRDNIQGITKP

SEQ ID NO: 10262 - protein, 8 aa, Homo sapiens
VVIAHDVD

SEQ ID NO: 10263 - protein, 9 aa, Homo sapiens
WMLDKLTGV

SEQ ID NO: 10264 - protein, 9 aa, Homo sapiens
YGMERVWCV

SEQ ID NO: 10265 - protein, 9 aa, Homo sapiens
YLARFLIKL

SEQ ID NO: 10266 - protein, 10 aa, Homo sapiens
YLFDEIDQAL

SEQ ID NO: 10267 - protein, 10 aa, Homo sapiens
YLFGERLLEC

SEQ ID NO: 10268 - protein, 9 aa, Homo sapiens
YLLKKLLQL

SEQ ID NO: 10269 - protein, 9 aa, Homo sapiens
YLYKYLWRL

SEQ ID NO: 10270 - protein, 9 aa, Mycobacterium tuberculosis
AAYPITGKL

SEQ ID NO: 10271 - protein, 9 aa, Mycobacterium tuberculosis
AIATFAAPV

SEQ ID NO: 10272 - protein, 9 aa, Mycobacterium tuberculosis
ATFAAPVAL

SEQ ID NO: 10273 - protein, 10 aa, Mycobacterium tuberculosis
AVAVVAMAAI

SEQ ID NO: 10274 - protein, 10 aa, Mycobacterium tuberculosis
TMIKTAVAVV

SEQ ID NO: 10275 - protein, 9 aa, Leishmania major
ALLAFTLGV

SEQ ID NO: 10276 - protein, 9 aa, Leishmania major
ALRERRMKV

SEQ ID NO: 10277 - protein, 9 aa, Leishmania major
CLALIAWRV

SEQ ID NO: 10278 - protein, 9 aa, Leishmania major
FMEVFGMLV

SEQ ID NO: 10279 - protein, 9 aa, Homo sapiens
FQNIRPLFI

SEQ ID NO: 10280 - protein, 9 aa, Leishmania major
GLEQQIQEI

SEQ ID NO: 10281 - protein, 9 aa, Leishmania major
KIYQIGRSV

SEQ ID NO: 10282 - protein, 9 aa, Leishmania major
KLVRELFRV

SEQ ID NO: 10283 - protein, 9 aa, Leishmania major
LLHDRQHSI

SEQ ID NO: 10284 - protein, 9 aa, Leishmania major
LLPAPLVSV

SEQ ID NO: 10285 - protein, 9 aa, Leishmania major
MLLWTAVAV

SEQ ID NO: 10286 - protein, 9 aa, Leishmania major
MLQTNSLAL

SEQ ID NO: 10287 - protein, 9 aa, Leishmania major
MLVQSCTSI

SEQ ID NO: 10288 - protein, 9 aa, Leishmania major
MVLNAMAWL

SEQ ID NO: 10289 - protein, 9 aa, Leishmania major
PLSPATRRL

SEQ ID NO: 10290 - protein, 9 aa, Leishmania major
QLNKKIYQI

SEQ ID NO: 10291 - protein, 9 aa, Leishmania major
RLAGFLAGL

SEQ ID NO: 10292 - protein, 9 aa, Leishmania major
SLQFSAFLL

SEQ ID NO: 10293 - protein, 10 aa, Homo sapiens
SQYPFHVPLL

SEQ ID NO: 10294 - protein, 9 aa, Leishmania major
TLGVKQMVV

SEQ ID NO: 10295 - protein, 9 aa, Leishmania major
TLLDALGML

SEQ ID NO: 10296 - protein, 9 aa, Leishmania major
TMLELLTQL

SEQ ID NO: 10297 - protein, 9 aa, Leishmania major
VVAGMLRWV

SEQ ID NO: 10298 - protein, 9 aa, Leishmania major
VVSVLTHSV

SEQ ID NO: 10299 - protein, 9 aa, Leishmania major
WIPPVVSVL

SEQ ID NO: 10300 - protein, 9 aa, Leishmania major
YLRTFPAAL

SEQ ID NO: 10301 - protein, 10 aa, Homo sapiens
AIAQALAGEV

SEQ ID NO: 10302 - protein, 10 aa, Homo sapiens
AIIGGVIAVV

SEQ ID NO: 10303 - protein, 9 aa, Homo sapiens
AILGIHNEV

SEQ ID NO: 10304 - protein, 10 aa, Homo sapiens
AINPKLLQLV

SEQ ID NO: 10305 - protein, 9 aa, Homo sapiens
AIQEQITRV

SEQ ID NO: 10306 - protein, 10 aa, Homo sapiens
ALDVQGIYRV

SEQ ID NO: 10307 - protein, 10 aa, Homo sapiens
ALFAGGKLRV

SEQ ID NO: 10308 - protein, 10 aa, Homo sapiens
ALFPGDVDRL

SEQ ID NO: 10309 - protein, 9 aa, Homo sapiens
ALGTLVSHV

SEQ ID NO: 10310 - protein, 9 aa, Homo sapiens
ALLEEAEQL

SEQ ID NO: 10311 - protein, 9 aa, Homo sapiens
ALLEQAEQL

SEQ ID NO: 10312 - protein, 9 aa, Homo sapiens
ALLETEFSL

SEQ ID NO: 10313 - protein, 9 aa, Homo sapiens
ALLPQASNV

SEQ ID NO: 10314 - protein, 9 aa, Homo sapiens
ALLSDVQLL

SEQ ID NO: 10315 - protein, 9 aa, Homo sapiens
ALNAVRLLV

SEQ ID NO: 10316 - protein, 10 aa, Homo sapiens
ALQGELKIAV

SEQ ID NO: 10317 - protein, 10 aa, Homo sapiens
ALVEKGEFAL

SEQ ID NO: 10318 - protein, 10 aa, Homo sapiens
AMKTRQAFYL

SEQ ID NO: 10319 - protein, 9 aa, Homo sapiens
AVDDFIEKL

SEQ ID NO: 10320 - protein, 9 aa, Homo sapiens
DIEGASKIL

SEQ ID NO: 10321 - protein, 10 aa, Homo sapiens
DIKDGVSDKV

SEQ ID NO: 10322 - protein, 10 aa, Homo sapiens
DILGLSKAAV

SEQ ID NO: 10323 - protein, 9 aa, Homo sapiens
DLATRNILV

SEQ ID NO: 10324 - protein, 9 aa, Homo sapiens
DLEVKQEEV

SEQ ID NO: 10325 - protein, 10 aa, Homo sapiens
DLSDIPGAQV

SEQ ID NO: 10326 - protein, 9 aa, Homo sapiens
DLVHDDFSV

SEQ ID NO: 10327 - protein, 9 aa, Homo sapiens
DVEEIFRKV

SEQ ID NO: 10328 - protein, 10 aa, Homo sapiens
EILQLPNGAL

SEQ ID NO: 10329 - protein, 9 aa, Homo sapiens
EIQGNINKV

SEQ ID NO: 10330 - protein, 9 aa, Homo sapiens
EIRTVLEKL

SEQ ID NO: 10331 - protein, 9 aa, Homo sapiens
ELANLAAFL

SEQ ID NO: 10332 - protein, 9 aa, Homo sapiens
ELKDRDKEL

SEQ ID NO: 10333 - protein, 9 aa, Homo sapiens
ELMQLEKEL

SEQ ID NO: 10334 - protein, 10 aa, Homo sapiens
ELSKGQAKKL

SEQ ID NO: 10335 - protein, 9 aa, Homo sapiens
EMDDLKLYL

SEQ ID NO: 10336 - protein, 9 aa, Homo sapiens
EVGMLHQQV

SEQ ID NO: 10337 - protein, 9 aa, Homo sapiens
EVKALNANL

SEQ ID NO: 10338 - protein, 10 aa, Homo sapiens
FIILGALLLL

SEQ ID NO: 10339 - protein, 9 aa, Homo sapiens
FLEMCNDLL

SEQ ID NO: 10340 - protein, 9 aa, Homo sapiens
FLFIFFFLL

SEQ ID NO: 10341 - protein, 10 aa, Homo sapiens
FLIVMHRSLV

SEQ ID NO: 10342 - protein, 9 aa, Homo sapiens
FLSRQLESL

SEQ ID NO: 10343 - protein, 9 aa, Homo sapiens
GIKAVDAPV

SEQ ID NO: 10344 - protein, 10 aa, Homo sapiens
GIKLSAIPVV

SEQ ID NO: 10345 - protein, 9 aa, Homo sapiens
GLDALKVTV

SEQ ID NO: 10346 - protein, 10 aa, Homo sapiens
GLDTFSGFKV

SEQ ID NO: 10347 - protein, 10 aa, Homo sapiens
GLQDFDLIRV

SEQ ID NO: 10348 - protein, 9 aa, Homo sapiens
GLRTIVTTL

SEQ ID NO: 10349 - protein, 9 aa, Homo sapiens
GLSPLLQKI

SEQ ID NO: 10350 - protein, 10 aa, Homo sapiens
GLSSPIYIDL

SEQ ID NO: 10351 - protein, 9 aa, Homo sapiens
GQYTDLLRL

SEQ ID NO: 10352 - protein, 9 aa, Homo sapiens
GVLPFVRGV

SEQ ID NO: 10353 - protein, 9 aa, Homo sapiens
HLEEQIAKV

SEQ ID NO: 10354 - protein, 9 aa, Homo sapiens
HLLQYNHRV

SEQ ID NO: 10355 - protein, 9 aa, Homo sapiens
HVCHINRIL

SEQ ID NO: 10356 - protein, 9 aa, Homo sapiens
IILEILLLL

SEQ ID NO: 10357 - protein, 10 aa, Homo sapiens
ILAPCKLETV

SEQ ID NO: 10358 - protein, 10 aa, Homo sapiens
ILDEQAVQGL

SEQ ID NO: 10359 - protein, 10 aa, Homo sapiens
ILLQIDNARL

SEQ ID NO: 10360 - protein, 10 aa, Homo sapiens
ILNEDGSPNL

SEQ ID NO: 10361 - protein, 9 aa, Homo sapiens
ILSKCNIQV

SEQ ID NO: 10362 - protein, 9 aa, Homo sapiens
KILPTPETV

SEQ ID NO: 10363 - protein, 9 aa, Homo sapiens
KINNEIRSV

SEQ ID NO: 10364 - protein, 9 aa, Homo sapiens
KISEEQQQL

SEQ ID NO: 10365 - protein, 9 aa, Homo sapiens
KISVIVETV

SEQ ID NO: 10366 - protein, 9 aa, Homo sapiens
KLDETGVAL

SEQ ID NO: 10367 - protein, 9 aa, Homo sapiens
KLDIISPQL

SEQ ID NO: 10368 - protein, 9 aa, Homo sapiens
KLEEKGVYV

SEQ ID NO: 10369 - protein, 9 aa, Homo sapiens
KLEGVLAEV

SEQ ID NO: 10370 - protein, 9 aa, Homo sapiens
KLFDSLTLL

SEQ ID NO: 10371 - protein, 10 aa, Homo sapiens
KLFQSNDPTL

SEQ ID NO: 10372 - protein, 9 aa, Homo sapiens
KLLEAISSL

SEQ ID NO: 10373 - protein, 10 aa, Homo sapiens
KLLEGEESRL

SEQ ID NO: 10374 - protein, 10 aa, Homo sapiens
KLLGLDVPSL

SEQ ID NO: 10375 - protein, 10 aa, Homo sapiens
KLQDAEIARL

SEQ ID NO: 10376 - protein, 9 aa, Homo sapiens
KLQEQVTDL

SEQ ID NO: 10377 - protein, 9 aa, Homo sapiens
KLQQLFIEL

SEQ ID NO: 10378 - protein, 9 aa, Homo sapiens
KLWPEASKV

SEQ ID NO: 10379 - protein, 9 aa, Homo sapiens
KMDDKALLV

SEQ ID NO: 10380 - protein, 9 aa, Homo sapiens
KVENLVDQL

SEQ ID NO: 10381 - protein, 9 aa, Homo sapiens
KVIDQQNGL

SEQ ID NO: 10382 - protein, 9 aa, Homo sapiens
KVLHHTAKL

SEQ ID NO: 10383 - protein, 9 aa, Homo sapiens
LITRNLQEV

SEQ ID NO: 10384 - protein, 9 aa, Homo sapiens
LLAEENQRL

SEQ ID NO: 10385 - protein, 9 aa, Homo sapiens
LLDTVLPHL

SEQ ID NO: 10386 - protein, 10 aa, Homo sapiens
LLFLLSQNRV

SEQ ID NO: 10387 - protein, 10 aa, Homo sapiens
LLGVGNNLLV

SEQ ID NO: 10388 - protein, 10 aa, Homo sapiens
LLLQHGGPVL

SEQ ID NO: 10389 - protein, 10 aa, Homo sapiens
LLNAGEIPNL

SEQ ID NO: 10390 - protein, 9 aa, Homo sapiens
LLNEDLEKV

SEQ ID NO: 10391 - protein, 9 aa, Homo sapiens
LLQCTRNIL

SEQ ID NO: 10392 - protein, 9 aa, Homo sapiens
LLQEEKLLL

SEQ ID NO: 10393 - protein, 9 aa, Homo sapiens
LLSDKDLTV

SEQ ID NO: 10394 - protein, 9 aa, Homo sapiens
LLYSGRTIL

SEQ ID NO: 10395 - protein, 9 aa, Homo sapiens
LVEINKILL

SEQ ID NO: 10396 - protein, 9 aa, Homo sapiens
MVCYTAQTL

SEQ ID NO: 10397 - protein, 9 aa, Homo sapiens
NIIPYITNV

SEQ ID NO: 10398 - protein, 10 aa, Homo sapiens
NLLEKDYFGL

SEQ ID NO: 10399 - protein, 9 aa, Homo sapiens
NLLHHPKLL

SEQ ID NO: 10400 - protein, 9 aa, Homo sapiens
PLRTKVAKL

SEQ ID NO: 10401 - protein, 9 aa, Homo sapiens
QIGRENPQL

SEQ ID NO: 10402 - protein, 9 aa, Homo sapiens
QINEQVEKL

SEQ ID NO: 10403 - protein, 9 aa, Homo sapiens
QIPPVSTPV

SEQ ID NO: 10404 - protein, 9 aa, Homo sapiens
QIQEKLQQL

SEQ ID NO: 10405 - protein, 9 aa, Homo sapiens
QLENLIEKL

SEQ ID NO: 10406 - protein, 9 aa, Homo sapiens
QLFKFDMNV

SEQ ID NO: 10407 - protein, 9 aa, Homo sapiens
QLKKELNEL

SEQ ID NO: 10408 - protein, 9 aa, Homo sapiens
QMVKGMLQL

SEQ ID NO: 10409 - protein, 10 aa, Homo sapiens
QVNAVTVLTL

SEQ ID NO: 10410 - protein, 10 aa, Homo sapiens
QVTVPPKKPV

SEQ ID NO: 10411 - protein, 10 aa, Homo sapiens
RIIGLKPEGV

SEQ ID NO: 10412 - protein, 9 aa, Homo sapiens
RLAADDFRV

SEQ ID NO: 10413 - protein, 9 aa, Homo sapiens
RLAAMLRQL

SEQ ID NO: 10414 - protein, 9 aa, Homo sapiens
RLAEVELRL

SEQ ID NO: 10415 - protein, 9 aa, Homo sapiens
RLAQGLTHL

SEQ ID NO: 10416 - protein, 9 aa, Homo sapiens
RLEEGIRFL

SEQ ID NO: 10417 - protein, 9 aa, Homo sapiens
RLKEENEKL

SEQ ID NO: 10418 - protein, 10 aa, Homo sapiens
RLLEGEDAHL

SEQ ID NO: 10419 - protein, 9 aa, Homo sapiens
RLLNFQRQL

SEQ ID NO: 10420 - protein, 9 aa, Homo sapiens
RLQEENQQL

SEQ ID NO: 10421 - protein, 10 aa, Homo sapiens
RLSQLEGVNV

SEQ ID NO: 10422 - protein, 10 aa, Homo sapiens
RLVGIHELFL

SEQ ID NO: 10423 - protein, 10 aa, Homo sapiens
RMFADDLHNL

SEQ ID NO: 10424 - protein, 9 aa, Homo sapiens
RQPDLVLRL

SEQ ID NO: 10425 - protein, 10 aa, Homo sapiens
RVIEKEIKDV

SEQ ID NO: 10426 - protein, 10 aa, Homo sapiens
SIDGVQQISL

SEQ ID NO: 10427 - protein, 9 aa, Homo sapiens
SLADFEKAL

SEQ ID NO: 10428 - protein, 9 aa, Homo sapiens
SLAKKCMAV

SEQ ID NO: 10429 - protein, 10 aa, Homo sapiens
SLAPDTRLFV

SEQ ID NO: 10430 - protein, 9 aa, Homo sapiens
SLAVSSPRL

SEQ ID NO: 10431 - protein, 9 aa, Homo sapiens
SLDDHVVAV

SEQ ID NO: 10432 - protein, 9 aa, Homo sapiens
SLDKDIVAL

SEQ ID NO: 10433 - protein, 9 aa, Homo sapiens
SLDKTSHSL

SEQ ID NO: 10434 - protein, 10 aa, Homo sapiens
SLIDIILISL

SEQ ID NO: 10435 - protein, 9 aa, Homo sapiens
SLIDQFFGV

SEQ ID NO: 10436 - protein, 9 aa, Homo sapiens
SLKEIVINV

SEQ ID NO: 10437 - protein, 9 aa, Homo sapiens
SLKPEVAQV

SEQ ID NO: 10438 - protein, 9 aa, Homo sapiens
SLSESWYNL

SEQ ID NO: 10439 - protein, 9 aa, Homo sapiens
SLVDIYSQL

SEQ ID NO: 10440 - protein, 10 aa, Homo sapiens
SLVEGEALHL

SEQ ID NO: 10441 - protein, 9 aa, Homo sapiens
SLYDQAEKL

SEQ ID NO: 10442 - protein, 9 aa, Homo sapiens
SVRSIVTTL

SEQ ID NO: 10443 - protein, 10 aa, Homo sapiens
TLTGKNVLIV

SEQ ID NO: 10444 - protein, 9 aa, Homo sapiens
TLWDIQKDL

SEQ ID NO: 10445 - protein, 9 aa, Homo sapiens
TVAENVYRL

SEQ ID NO: 10446 - protein, 9 aa, Homo sapiens
TVILEIPEL

SEQ ID NO: 10447 - protein, 10 aa, Homo sapiens
TVLTSALSPV

SEQ ID NO: 10448 - protein, 9 aa, Homo sapiens
TVMNTIQQL

SEQ ID NO: 10449 - protein, 9 aa, Homo sapiens
VLDSKSVEV

SEQ ID NO: 10450 - protein, 10 aa, Homo sapiens
VLFTGREFFV

SEQ ID NO: 10451 - protein, 9 aa, Homo sapiens
YIDDVFHAL

SEQ ID NO: 10452 - protein, 10 aa, Homo sapiens
YILDCNGIAV

SEQ ID NO: 10453 - protein, 9 aa, Homo sapiens
YLDKTFYNL

SEQ ID NO: 10454 - protein, 10 aa, Homo sapiens
YLITGNLEKL

SEQ ID NO: 10455 - protein, 10 aa, Homo sapiens
YLLILKACVV

SEQ ID NO: 10456 - protein, 9 aa, Homo sapiens
YLQIHPQEL

SEQ ID NO: 10457 - protein, 10 aa, Homo sapiens
YLSDEGHYWV

SEQ ID NO: 10458 - protein, 11 aa, Homo sapiens
HEQLSVAEITN

SEQ ID NO: 10459 - protein, 9 aa, Homo sapiens
CLGHNHKEV

SEQ ID NO: 10460 - protein, 10 aa, Homo sapiens
KIADPICTFI

SEQ ID NO: 10461 - protein, 10 aa, Homo sapiens
KMYAFTLESV

SEQ ID NO: 10462 - protein, 10 aa, Homo sapiens
LLIDLTSFLL

SEQ ID NO: 10463 - protein, 10 aa, Homo sapiens
VMIIVSSLAV

SEQ ID NO: 10464 - protein, 9 aa, Homo sapiens
FILPVLGAV

SEQ ID NO: 10465 - protein, 9 aa, Homo sapiens
AAAAVIPTV

SEQ ID NO: 10466 - protein, 9 aa, Homo sapiens
AILPTSIFL

SEQ ID NO: 10467 - protein, 9 aa, Homo sapiens
AIMENANVL

SEQ ID NO: 10468 - protein, 9 aa, Homo sapiens
ALAKIEIKL

SEQ ID NO: 10469 - protein, 9 aa, Homo sapiens
ALDGLLQQV

SEQ ID NO: 10470 - protein, 9 aa, Homo sapiens
ALDTTRHEL

SEQ ID NO: 10471 - protein, 9 aa, Homo sapiens
ALGPGVPHI

SEQ ID NO: 10472 - protein, 11 aa, Homo sapiens
ALLGGNVRMML

SEQ ID NO: 10473 - protein, 9 aa, Homo sapiens
ALLPQNHKL

SEQ ID NO: 10474 - protein, 9 aa, Homo sapiens
ALLQQPLFL

SEQ ID NO: 10475 - protein, 9 aa, Homo sapiens
ALVNVQIPL

SEQ ID NO: 10476 - protein, 9 aa, Homo sapiens
ALYHFNHSL

SEQ ID NO: 10477 - protein, 9 aa, Homo sapiens
ALYSELLAV

SEQ ID NO: 10478 - protein, 9 aa, Homo sapiens
FAYPAIRYL

SEQ ID NO: 10479 - protein, 9 aa, Homo sapiens
FLAGAVTSV

SEQ ID NO: 10480 - protein, 11 aa, Homo sapiens
FLAPDNSLLLA

SEQ ID NO: 10481 - protein, 9 aa, Homo sapiens
FLFGYPKRL

SEQ ID NO: 10482 - protein, 9 aa, Homo sapiens
FLIPIYHQV

SEQ ID NO: 10483 - protein, 12 aa, Homo sapiens
FLIQDQQGLITL

SEQ ID NO: 10484 - protein, 10 aa, Homo sapiens
FLLPTGLSSL

SEQ ID NO: 10485 - protein, 11 aa, Homo sapiens
FLLRVGADPAL

SEQ ID NO: 10486 - protein, 9 aa, Homo sapiens
FLPAGIVAV

SEQ ID NO: 10487 - protein, 9 aa, Homo sapiens
FLTDREVRL

SEQ ID NO: 10488 - protein, 9 aa, Homo sapiens
FLTGVTTEL

SEQ ID NO: 10489 - protein, 10 aa, Homo sapiens
FLYNEALYSL

SEQ ID NO: 10490 - protein, 9 aa, Homo sapiens
FVFSFPVSV

SEQ ID NO: 10491 - protein, 9 aa, Homo sapiens
FVRDMIREV

SEQ ID NO: 10492 - protein, 9 aa, Homo sapiens
GLASVVQAL

SEQ ID NO: 10493 - protein, 9 aa, Homo sapiens
GLAVILPPL

SEQ ID NO: 10494 - protein, 9 aa, Homo sapiens
GLDSYLPEL

SEQ ID NO: 10495 - protein, 9 aa, Homo sapiens
GLDTVVALL

SEQ ID NO: 10496 - protein, 9 aa, Homo sapiens
GLIENPALL

SEQ ID NO: 10497 - protein, 9 aa, Homo sapiens
GLKGRVFEV

SEQ ID NO: 10498 - protein, 9 aa, Homo sapiens
GLKHDIARV

SEQ ID NO: 10499 - protein, 10 aa, Homo sapiens
GLLESGRHYL

SEQ ID NO: 10500 - protein, 9 aa, Homo sapiens
GLLPKLTAL

SEQ ID NO: 10501 - protein, 12 aa, Homo sapiens
GLMDEKLLHNVL

SEQ ID NO: 10502 - protein, 9 aa, Homo sapiens
GLPELVIQL

SEQ ID NO: 10503 - protein, 10 aa, Homo sapiens
GMFKNLLKEV

SEQ ID NO: 10504 - protein, 11 aa, Homo sapiens
HVYDGKFLARV

SEQ ID NO: 10505 - protein, 9 aa, Homo sapiens
IAPPVPLKA

SEQ ID NO: 10506 - protein, 9 aa, Homo sapiens
IIENIVAVT

SEQ ID NO: 10507 - protein, 10 aa, Homo sapiens
IIHEIAVLEL

SEQ ID NO: 10508 - protein, 9 aa, Homo sapiens
ILDHEVPSL

SEQ ID NO: 10509 - protein, 10 aa, Homo sapiens
ILFDHMVPLV

SEQ ID NO: 10510 - protein, 10 aa, Homo sapiens
ILHEIAVLEL

SEQ ID NO: 10511 - protein, 11 aa, Homo sapiens
ILLDDTGLAYI

SEQ ID NO: 10512 - protein, 9 aa, Homo sapiens
IVAEIIKKV

SEQ ID NO: 10513 - protein, 9 aa, Homo sapiens
KIKEIAVTV

SEQ ID NO: 10514 - protein, 9 aa, Homo sapiens
KIVDLLKNL

SEQ ID NO: 10515 - protein, 9 aa, Homo sapiens
KLMAPDISL

SEQ ID NO: 10516 - protein, 9 aa, Homo sapiens
KVQEQVHKV

SEQ ID NO: 10517 - protein, 9 aa, Homo sapiens
LAGTALAAL

SEQ ID NO: 10518 - protein, 10 aa, Homo sapiens
LIKEVDIYTV

SEQ ID NO: 10519 - protein, 9 aa, Homo sapiens
LILGKLHYV

SEQ ID NO: 10520 - protein, 9 aa, Homo sapiens
LLLAATPGL

SEQ ID NO: 10521 - protein, 9 aa, Homo sapiens
LLLDVPTAA

SEQ ID NO: 10522 - protein, 10 aa, Homo sapiens
LLLSAEPVPA

SEQ ID NO: 10523 - protein, 9 aa, Homo sapiens
LLQDIILQV

SEQ ID NO: 10524 - protein, 11 aa, Homo sapiens
LMWELEKKSAV

SEQ ID NO: 10525 - protein, 9 aa, Homo sapiens
MAPARLFAL

SEQ ID NO: 10526 - protein, 11 aa, Homo sapiens
NIASIGSTIFL

SEQ ID NO: 10527 - protein, 11 aa, Homo sapiens
QLLPQGIVPAL

SEQ ID NO: 10528 - protein, 9 aa, Homo sapiens
RLIDRIKTV

SEQ ID NO: 10529 - protein, 9 aa, Homo sapiens
RLSPVSPAL

SEQ ID NO: 10530 - protein, 9 aa, Homo sapiens
SIAPRMMSV

SEQ ID NO: 10531 - protein, 9 aa, Homo sapiens
SIIPPLFTV

SEQ ID NO: 10532 - protein, 9 aa, Homo sapiens
SLASFIPAV

SEQ ID NO: 10533 - protein, 9 aa, Homo sapiens
SLLGGVLRV

SEQ ID NO: 10534 - protein, 9 aa, Homo sapiens
SLLRDVPLA

SEQ ID NO: 10535 - protein, 9 aa, Homo sapiens
SLSHLVPAL

SEQ ID NO: 10536 - protein, 9 aa, Homo sapiens
SLTSVVLTL

SEQ ID NO: 10537 - protein, 9 aa, Homo sapiens
SMHQILLYL

SEQ ID NO: 10538 - protein, 12 aa, Homo sapiens
SMMGPSPGPPSV

SEQ ID NO: 10539 - protein, 9 aa, Homo sapiens
SQIPAQPSV

SEQ ID NO: 10540 - protein, 9 aa, Homo sapiens
SVGSRPPAV

SEQ ID NO: 10541 - protein, 9 aa, Homo sapiens
TILKRLFRV

SEQ ID NO: 10542 - protein, 9 aa, Homo sapiens
TLAAIAVHL

SEQ ID NO: 10543 - protein, 9 aa, Homo sapiens
TLFGLTPTL

SEQ ID NO: 10544 - protein, 9 aa, Homo sapiens
TLFPRRIFL

SEQ ID NO: 10545 - protein, 9 aa, Homo sapiens
TLGDAHIYL

SEQ ID NO: 10546 - protein, 9 aa, Homo sapiens
TLSPRPPLI

SEQ ID NO: 10547 - protein, 9 aa, Homo sapiens
TLSSLVFQL

SEQ ID NO: 10548 - protein, 9 aa, Homo sapiens
VLQRSLVTV

SEQ ID NO: 10549 - protein, 9 aa, Homo sapiens
VMFKTPVSI

SEQ ID NO: 10550 - protein, 9 aa, Homo sapiens
YANAKIYKL

SEQ ID NO: 10551 - protein, 9 aa, Homo sapiens
YIYKDTIQV

SEQ ID NO: 10552 - protein, 9 aa, Homo sapiens
YLDRLIPQA

SEQ ID NO: 10553 - protein, 9 aa, Homo sapiens
YLFGRNPDL

SEQ ID NO: 10554 - protein, 9 aa, Homo sapiens
YLIASIDHL

SEQ ID NO: 10555 - protein, 12 aa, Homo sapiens
YLIGLDPENLAL

SEQ ID NO: 10556 - protein, 9 aa, Homo sapiens
YLLEKFVAV

SEQ ID NO: 10557 - protein, 10 aa, Homo sapiens
YLNDLHEVLL

SEQ ID NO: 10558 - protein, 9 aa, Homo sapiens
YLSNVDVYL

SEQ ID NO: 10559 - protein, 9 aa, Homo sapiens
YLYDRLLRI

SEQ ID NO: 10560 - protein, 9 aa, Human alphaherpesvirus 3
FLMEDQTLL

SEQ ID NO: 10561 - protein, 9 aa, Homo sapiens
SAFATPFLV

SEQ ID NO: 10562 - protein, 9 aa, Influenza A virus
GIEGFVFTL

SEQ ID NO: 10563 - protein, 8 aa, Homo sapiens
IIGRLLEV

SEQ ID NO: 10564 - protein, 9 aa, Trypanosoma cruzi
TLLEFVFKL

SEQ ID NO: 10565 - protein, 9 aa, Homo sapiens
YVTPVNRNV

SEQ ID NO: 10566 - protein, 9 aa, Homo sapiens
ALEPGPVTA

SEQ ID NO: 10567 - protein, 9 aa, Homo sapiens
YLEAGPVTA

SEQ ID NO: 10568 - protein, 9 aa, Homo sapiens
YLEPGAVTA

SEQ ID NO: 10569 - protein, 9 aa, Homo sapiens
YLEPGPATA

SEQ ID NO: 10570 - protein, 9 aa, Homo sapiens
YLEPGPVAA

SEQ ID NO: 10571 - protein, 9 aa, Influenza A virus (A/chicken/Anhui/1/1998(H9N2))
GILEFVFTL

SEQ ID NO: 10572 - protein, 9 aa, Influenza A virus (A/England/10/67(H2N2))
GILGFIFTL

SEQ ID NO: 10573 - protein, 9 aa, Influenza A virus (A/New South Wales/15/1999(H3N2))
GILGFVYTL

SEQ ID NO: 10574 - protein, 9 aa, Influenza A virus (A/Canterbury/236/2005(H3N2))
GILGLVFTL

SEQ ID NO: 10575 - protein, 9 aa, Influenza A virus (A/Cameron/1946(H1N1))
GILGVVFTL

SEQ ID NO: 10576 - protein, 9 aa, Influenza A virus (A/bar-headed goose/Qinghai/3/2005(H5N1))
GIWGFVFTL

SEQ ID NO: 10577 - protein, 9 aa, Influenza A virus (A/duck/Fujian/13/2002(H5N1))
GTLGFVFTL

SEQ ID NO: 10578 - protein, 9 aa, Influenza A virus (A/Hanoi/TN405/2005(H3N2))
GVLGFVFTL

SEQ ID NO: 10579 - protein, 9 aa, Influenza A virus (A/swine/Guangdong/01/2005(H3N2))
WILGFVFTL

SEQ ID NO: 10580 - protein, 9 aa, Human alphaherpesvirus 1
ALHTALATV

SEQ ID NO: 10581 - protein, 9 aa, Herpes simplex virus (type 1 / strain 17)
ALSALLTKL

SEQ ID NO: 10582 - protein, 9 aa, Herpes simplex virus (type 1 / strain 17)
FLTCTDRSV

SEQ ID NO: 10583 - protein, 9 aa, Homo sapiens
AWLVAAAEI

SEQ ID NO: 10584 - protein, 9 aa, Homo sapiens
KLVMSQANV

SEQ ID NO: 10585 - protein, 9 aa, Homo sapiens
MPGEATETV

SEQ ID NO: 10586 - protein, 9 aa, Homo sapiens
SQQAQLAAA

SEQ ID NO: 10587 - protein, 9 aa, Human metapneumovirus
FQANTPPAV

SEQ ID NO: 10588 - protein, 9 aa, Hepatitis C virus subtype 3a
LYPSLIFDI

SEQ ID NO: 10589 - protein, 10 aa, Hepatitis C virus subtype 3a
VLDDHYKTAL

SEQ ID NO: 10590 - protein, 10 aa, Plasmodium falciparum 3D7
FLFVEALFQE

SEQ ID NO: 10591 - protein, 10 aa, Plasmodium falciparum 3D7
SVFNVVNSSI

SEQ ID NO: 10592 - protein, 10 aa, Plasmodium falciparum 3D7
SVSSFLFVEA

SEQ ID NO: 10593 - protein, 9 aa, Homo sapiens
AILKYIETL

SEQ ID NO: 10594 - protein, 9 aa, Homo sapiens
ALAATVFCV

SEQ ID NO: 10595 - protein, 9 aa, Homo sapiens
ALASLENHV

SEQ ID NO: 10596 - protein, 9 aa, Homo sapiens
ALDANIARL

SEQ ID NO: 10597 - protein, 9 aa, Homo sapiens
ALDDIIYRA

SEQ ID NO: 10598 - protein, 9 aa, Homo sapiens
ALDGKIYEL

SEQ ID NO: 10599 - protein, 8 aa, Homo sapiens
ALGNVRTV

SEQ ID NO: 10600 - protein, 9 aa, Homo sapiens
ALKKQLPGV

SEQ ID NO: 10601 - protein, 9 aa, Homo sapiens
ALKNGQYWV

SEQ ID NO: 10602 - protein, 10 aa, Homo sapiens
ALLESSLRQA

SEQ ID NO: 10603 - protein, 10 aa, Homo sapiens
ALPTVSPPGV

SEQ ID NO: 10604 - protein, 9 aa, Homo sapiens
ALRVFVESV

SEQ ID NO: 10605 - protein, 11 aa, Homo sapiens
ALSNSDVIRQV

SEQ ID NO: 10606 - protein, 9 aa, Homo sapiens
ALVDCSVAL

SEQ ID NO: 10607 - protein, 10 aa, Homo sapiens
ALWGFFPVLL

SEQ ID NO: 10608 - protein, 10 aa, Homo sapiens
ALWKGRPLSV

SEQ ID NO: 10609 - protein, 11 aa, Homo sapiens
AMFESSQNVLL

SEQ ID NO: 10610 - protein, 9 aa, Homo sapiens
ATADYICKV

SEQ ID NO: 10611 - protein, 9 aa, Homo sapiens
FAHPSLWQL

SEQ ID NO: 10612 - protein, 9 aa, Homo sapiens
FFMERSWSV

SEQ ID NO: 10613 - protein, 9 aa, Homo sapiens
FGLARAFGV

SEQ ID NO: 10614 - protein, 9 aa, Homo sapiens
FIHQHFVEV

SEQ ID NO: 10615 - protein, 9 aa, Homo sapiens
FLDKNNDLL

SEQ ID NO: 10616 - protein, 9 aa, Homo sapiens
FLIDRSPEY

SEQ ID NO: 10617 - protein, 9 aa, Homo sapiens
FLKEKVPGI

SEQ ID NO: 10618 - protein, 9 aa, Homo sapiens
FLLDHGASL

SEQ ID NO: 10619 - protein, 9 aa, Homo sapiens
FLPASLRSV

SEQ ID NO: 10620 - protein, 9 aa, Toxoplasma gondii ME49
FMHGKIPTL

SEQ ID NO: 10621 - protein, 9 aa, Homo sapiens
FSFPVSVGV

SEQ ID NO: 10622 - protein, 9 aa, Homo sapiens
FTQDSNYLL

SEQ ID NO: 10623 - protein, 9 aa, Homo sapiens
FVIRNIVEA

SEQ ID NO: 10624 - protein, 8 aa, Homo sapiens
GLGRVWAV

SEQ ID NO: 10625 - protein, 9 aa, Homo sapiens
GLSNLTHVL

SEQ ID NO: 10626 - protein, 10 aa, Homo sapiens
GLWHGMFANV

SEQ ID NO: 10627 - protein, 9 aa, Homo sapiens
GLYPKVAKI

SEQ ID NO: 10628 - protein, 9 aa, Homo sapiens
HLAEHSLQV

SEQ ID NO: 10629 - protein, 9 aa, Homo sapiens
HLAVVAPRL

SEQ ID NO: 10630 - protein, 9 aa, Homo sapiens
HLTYLNVYL

SEQ ID NO: 10631 - protein, 9 aa, Homo sapiens
ILDDACMNV

SEQ ID NO: 10632 - protein, 9 aa, Homo sapiens
ILDSRLIAA

SEQ ID NO: 10633 - protein, 8 aa, Homo sapiens
ILHDVVEV

SEQ ID NO: 10634 - protein, 9 aa, Homo sapiens
ILHTDVVYL

SEQ ID NO: 10635 - protein, 9 aa, Homo sapiens
ILPERFLAV

SEQ ID NO: 10636 - protein, 9 aa, Homo sapiens
IVNGHTLLV

SEQ ID NO: 10637 - protein, 9 aa, Homo sapiens
KASEKILQV

SEQ ID NO: 10638 - protein, 11 aa, Homo sapiens
KIWEELSVLEV

SEQ ID NO: 10639 - protein, 9 aa, Homo sapiens
KLDDYVYYV

SEQ ID NO: 10640 - protein, 10 aa, Homo sapiens
KLLDKPEQFL

SEQ ID NO: 10641 - protein, 11 aa, Homo sapiens
KMDASLGNLFA

SEQ ID NO: 10642 - protein, 11 aa, Homo sapiens
KMVDGVGVCTV

SEQ ID NO: 10643 - protein, 9 aa, Homo sapiens
KSIARVLTV

SEQ ID NO: 10644 - protein, 9 aa, Homo sapiens
KTLGKLWRL

SEQ ID NO: 10645 - protein, 9 aa, Homo sapiens
KTTTIAVEV

SEQ ID NO: 10646 - protein, 10 aa, Homo sapiens
KTWDQVPFSV

SEQ ID NO: 10647 - protein, 9 aa, Homo sapiens
KVADGLVKV

SEQ ID NO: 10648 - protein, 9 aa, Homo sapiens
KVLEHVVRV

SEQ ID NO: 10649 - protein, 10 aa, Homo sapiens
LILEKQPAYV

SEQ ID NO: 10650 - protein, 9 aa, Homo sapiens
LLAEKVEQL

SEQ ID NO: 10651 - protein, 9 aa, Homo sapiens
LLAPKLNEA

SEQ ID NO: 10652 - protein, 9 aa, Homo sapiens
LLDLIQTKV

SEQ ID NO: 10653 - protein, 10 aa, Homo sapiens
LLFGKIGYYL

SEQ ID NO: 10654 - protein, 8 aa, Homo sapiens
LLGSAHEV

SEQ ID NO: 10655 - protein, 11 aa, Homo sapiens
LLMEKEDYHSL

SEQ ID NO: 10656 - protein, 9 aa, Homo sapiens
LLNAILHSA

SEQ ID NO: 10657 - protein, 9 aa, Homo sapiens
LLWGDLIWL

SEQ ID NO: 10658 - protein, 10 aa, Homo sapiens
LLYDFQLINV

SEQ ID NO: 10659 - protein, 9 aa, Homo sapiens
LQSDVTCQV

SEQ ID NO: 10660 - protein, 9 aa, Homo sapiens
LTFPVRDGV

SEQ ID NO: 10661 - protein, 9 aa, Homo sapiens
LYLGLFNRL

SEQ ID NO: 10662 - protein, 9 aa, Homo sapiens
LYPQFMFHL

SEQ ID NO: 10663 - protein, 9 aa, Homo sapiens
MVLPLLIFV

SEQ ID NO: 10664 - protein, 9 aa, Homo sapiens
QLEERTWLL

SEQ ID NO: 10665 - protein, 9 aa, Homo sapiens
QQNPRLVYV

SEQ ID NO: 10666 - protein, 11 aa, Homo sapiens
RLLQETMYMTV

SEQ ID NO: 10667 - protein, 9 aa, Homo sapiens
RLYSVSYLL

SEQ ID NO: 10668 - protein, 9 aa, Homo sapiens
RQFLFHWTV

SEQ ID NO: 10669 - protein, 10 aa, Homo sapiens
SAWISKPPGV

SEQ ID NO: 10670 - protein, 9 aa, Homo sapiens
SILADRILL

SEQ ID NO: 10671 - protein, 9 aa, Homo sapiens
SISAGIPKV

SEQ ID NO: 10672 - protein, 11 aa, Homo sapiens
SLADTNSLAVV

SEQ ID NO: 10673 - protein, 9 aa, Homo sapiens
SLAELIQAL

SEQ ID NO: 10674 - protein, 11 aa, Homo sapiens
SLDDYNHLVTL

SEQ ID NO: 10675 - protein, 9 aa, Homo sapiens
SLDEKPRIV

SEQ ID NO: 10676 - protein, 9 aa, Homo sapiens
SLFGNIKGA

SEQ ID NO: 10677 - protein, 9 aa, Homo sapiens
SLFSGKPEV

SEQ ID NO: 10678 - protein, 9 aa, Homo sapiens
SLHFLILYV

SEQ ID NO: 10679 - protein, 9 aa, Homo sapiens
SLIDGIKRA

SEQ ID NO: 10680 - protein, 9 aa, Homo sapiens
SLIHGLWNL

SEQ ID NO: 10681 - protein, 9 aa, Homo sapiens
SLLDNLLTI

SEQ ID NO: 10682 - protein, 9 aa, Homo sapiens
SLLNVVMDL

SEQ ID NO: 10683 - protein, 9 aa, Homo sapiens
SLLTSLVTA

SEQ ID NO: 10684 - protein, 9 aa, Homo sapiens
SLMKDFPGA

SEQ ID NO: 10685 - protein, 8 aa, Homo sapiens
SLMWTLLK

SEQ ID NO: 10686 - protein, 10 aa, Homo sapiens
SLQEEKLIYV

SEQ ID NO: 10687 - protein, 10 aa, Homo sapiens
SLSGVMLTDV

SEQ ID NO: 10688 - protein, 9 aa, Homo sapiens
SLSSLELFL

SEQ ID NO: 10689 - protein, 9 aa, Homo sapiens
SLSSLLVKL

SEQ ID NO: 10690 - protein, 9 aa, Homo sapiens
SLWKGLVGI

SEQ ID NO: 10691 - protein, 12 aa, Homo sapiens
SMLEEGKEPWTV

SEQ ID NO: 10692 - protein, 9 aa, Homo sapiens
SQFSGKITV

SEQ ID NO: 10693 - protein, 9 aa, Homo sapiens
SVALKGHSL

SEQ ID NO: 10694 - protein, 9 aa, Homo sapiens
SVIEQLFFV

SEQ ID NO: 10695 - protein, 9 aa, Homo sapiens
SVTSHIYQV

SEQ ID NO: 10696 - protein, 9 aa, Homo sapiens
TLAAVLQRI

SEQ ID NO: 10697 - protein, 9 aa, Homo sapiens
TLDEKVAEL

SEQ ID NO: 10698 - protein, 9 aa, Homo sapiens
TLLESIQHV

SEQ ID NO: 10699 - protein, 9 aa, Homo sapiens
TLLESIRQA

SEQ ID NO: 10700 - protein, 9 aa, Homo sapiens
TLLRALQAL

SEQ ID NO: 10701 - protein, 9 aa, Homo sapiens
TLSTVISKV

SEQ ID NO: 10702 - protein, 9 aa, Homo sapiens
TLVPMPVRV

SEQ ID NO: 10703 - protein, 9 aa, Homo sapiens
TLWYRAPEV

SEQ ID NO: 10704 - protein, 11 aa, Homo sapiens
TLWYRAPEVLL

SEQ ID NO: 10705 - protein, 9 aa, Toxoplasma gondii ME49
TLWYRPPEL

SEQ ID NO: 10706 - protein, 9 aa, Homo sapiens
VLFTITKTV

SEQ ID NO: 10707 - protein, 8 aa, Homo sapiens
VLGKIEKV

SEQ ID NO: 10708 - protein, 9 aa, Homo sapiens
VLGPKIEAV

SEQ ID NO: 10709 - protein, 9 aa, Homo sapiens
VLSECIEGV

SEQ ID NO: 10710 - protein, 10 aa, Homo sapiens
VLSSDGVWRV

SEQ ID NO: 10711 - protein, 12 aa, Homo sapiens
VLYRYGSFSVTL

SEQ ID NO: 10712 - protein, 9 aa, Homo sapiens
VMDAALLLI

SEQ ID NO: 10713 - protein, 10 aa, Homo sapiens
WLDPNETNEI

SEQ ID NO: 10714 - protein, 8 aa, Homo sapiens
YLGKVLEL

SEQ ID NO: 10715 - protein, 11 aa, Homo sapiens
YLMDINGKMWL

SEQ ID NO: 10716 - protein, 9 aa, Homo sapiens
YLPPGFLSA

SEQ ID NO: 10717 - protein, 10 aa, Homo sapiens
YLRGGAITEV

SEQ ID NO: 10718 - protein, 9 aa, Homo sapiens
YLSEKVLAA

SEQ ID NO: 10719 - protein, 9 aa, Homo sapiens
YLVYILNEL

SEQ ID NO: 10720 - protein, 9 aa, Homo sapiens
YVIELQHVV

SEQ ID NO: 10721 - protein, 10 aa, Toxoplasma gondii GT1
AILEYLTAEV

SEQ ID NO: 10722 - protein, 12 aa, Toxoplasma gondii GT1
ALAEPVTGVGEA

SEQ ID NO: 10723 - protein, 10 aa, Toxoplasma gondii GT1
ALLRLDDLFI

SEQ ID NO: 10724 - protein, 9 aa, Toxoplasma gondii GT1
ALPAVGMGA

SEQ ID NO: 10725 - protein, 12 aa, Toxoplasma gondii GT1
ALVEAFKAIQRA

SEQ ID NO: 10726 - protein, 9 aa, Homo sapiens
AQFEHTLLV

SEQ ID NO: 10727 - protein, 11 aa, Toxoplasma gondii GT1
AVPGDNVGFNV

SEQ ID NO: 10728 - protein, 14 aa, Toxoplasma gondii GT1
FANTIIEEADEAMN

SEQ ID NO: 10729 - protein, 18 aa, Homo sapiens
FGIVEGLMTTVINDISTL

SEQ ID NO: 10730 - protein, 18 aa, Toxoplasma gondii
FGLVEGLMTTVINDISTL

SEQ ID NO: 10731 - protein, 11 aa, Toxoplasma gondii GT1
FIMDEADEMLS

SEQ ID NO: 10732 - protein, 9 aa, Toxoplasma gondii GT1
FITLHVPLL

SEQ ID NO: 10733 - protein, 9 aa, Toxoplasma gondii GT1
FLALHILTA

SEQ ID NO: 10734 - protein, 12 aa, Toxoplasma gondii GT1
FLAQVIVLNHPG

SEQ ID NO: 10735 - protein, 10 aa, Toxoplasma gondii GT1
FLDELAKVFT

SEQ ID NO: 10736 - protein, 11 aa, Toxoplasma gondii GT1
FLFEDDTPKKP

SEQ ID NO: 10737 - protein, 12 aa, Toxoplasma gondii GT1
FLFEDDTPKKPK

SEQ ID NO: 10738 - protein, 12 aa, Toxoplasma gondii GT1
FLLDDLKQILVT

SEQ ID NO: 10739 - protein, 11 aa, Toxoplasma gondii ME49
FLLSTRAGGLG

SEQ ID NO: 10740 - protein, 9 aa, Toxoplasma gondii GT1
FLNTVEVRV

SEQ ID NO: 10741 - protein, 10 aa, Toxoplasma gondii GT1
FLNTVEVRVT

SEQ ID NO: 10742 - protein, 11 aa, Toxoplasma gondii GT1
FLNTVEVRVTG

SEQ ID NO: 10743 - protein, 10 aa, Toxoplasma gondii GT1
FLTNEGIEFL

SEQ ID NO: 10744 - protein, 12 aa, Toxoplasma gondii GT1
FLTNEGIEFLRT

SEQ ID NO: 10745 - protein, 12 aa, Toxoplasma gondii GT1
FMADETDLAGRS

SEQ ID NO: 10746 - protein, 11 aa, Toxoplasma gondii ME49
FMDPPAPETLM

SEQ ID NO: 10747 - protein, 17 aa, Toxoplasma gondii GT1
FRGLLAEARIVGACETF

SEQ ID NO: 10748 - protein, 9 aa, Toxoplasma gondii GT1
FVDTLKTLA

SEQ ID NO: 10749 - protein, 12 aa, Toxoplasma gondii GT1
FVLELEPEWTVK

SEQ ID NO: 10750 - protein, 10 aa, Homo sapiens
FVYPLDFART

SEQ ID NO: 10751 - protein, 9 aa, Prochlorococcus phage P-HM1
GGNGMLATI

SEQ ID NO: 10752 - protein, 14 aa, Toxoplasma gondii GT1
GILNFLTSVDEAMN

SEQ ID NO: 10753 - protein, 9 aa, Toxoplasma gondii ME49
GLDKQIQEL

SEQ ID NO: 10754 - protein, 10 aa, Homo sapiens
GLDNAGKTTI

SEQ ID NO: 10755 - protein, 10 aa, Toxoplasma gondii ME49
GLDNAGKTTL

SEQ ID NO: 10756 - protein, 9 aa, Homo sapiens
GLSAFLHAI

SEQ ID NO: 10757 - protein, 9 aa, Toxoplasma gondii GT1
GLVEGLMTT

SEQ ID NO: 10758 - protein, 10 aa, Toxoplasma gondii GT1
GLVEGLMTTV

SEQ ID NO: 10759 - protein, 10 aa, Toxoplasma gondii GT1
GMEEGEFSEA

SEQ ID NO: 10760 - protein, 11 aa, Toxoplasma gondii GT1
GQAPVDSLRPT

SEQ ID NO: 10761 - protein, 11 aa, Toxoplasma gondii GT1
GVIEEDLKAVV

SEQ ID NO: 10762 - protein, 18 aa, Toxoplasma gondii ME49
HIVGLDIFTGKINDISTI

SEQ ID NO: 10763 - protein, 9 aa, Toxoplasma gondii ME49
HLDATTVLS

SEQ ID NO: 10764 - protein, 11 aa, Toxoplasma gondii ME49
HLLDFPNIVIK

SEQ ID NO: 10765 - protein, 11 aa, Toxoplasma gondii GT1
HLLQTDASAQL

SEQ ID NO: 10766 - protein, 11 aa, Toxoplasma gondii GT1
HLMDEAVEVAK

SEQ ID NO: 10767 - protein, 18 aa, Homo sapiens
HLVGIDIFTGKINDISTL

SEQ ID NO: 10768 - protein, 9 aa, Toxoplasma gondii GT1
IIIDEIHLL

SEQ ID NO: 10769 - protein, 10 aa, Toxoplasma gondii GT1
ILFDSKLATI

SEQ ID NO: 10770 - protein, 11 aa, Toxoplasma gondii GT1
ILFDSKLATIR

SEQ ID NO: 10771 - protein, 11 aa, Toxoplasma gondii GT1
ILLELEAPIKI

SEQ ID NO: 10772 - protein, 12 aa, Toxoplasma gondii GT1
ILMDLEPGTMDS

SEQ ID NO: 10773 - protein, 11 aa, Toxoplasma gondii ME49
ILPDSLPLDTL

SEQ ID NO: 10774 - protein, 9 aa, Toxoplasma gondii GT1
ILTAQLIRL

SEQ ID NO: 10775 - protein, 17 aa, Toxoplasma gondii GT1
IRKLFNLSKDQDDEAMQ

SEQ ID NO: 10776 - protein, 9 aa, Crimean-Congo hemorrhagic fever orthonairovirus
ITNCLLSTA

SEQ ID NO: 10777 - protein, 9 aa, Eastern equine encephalitis virus
IVLGLIATA

SEQ ID NO: 10778 - protein, 9 aa, Human adenovirus 12
KDLVLLATI

SEQ ID NO: 10779 - protein, 9 aa, Toxoplasma gondii GT1
KLALPAVGM

SEQ ID NO: 10780 - protein, 11 aa, Toxoplasma gondii GT1
KLALPAVGMGA

SEQ ID NO: 10781 - protein, 12 aa, Toxoplasma gondii GT1
KLDESEQTLEVL

SEQ ID NO: 10782 - protein, 12 aa, Toxoplasma gondii GT1
KLEEIDDLLQLT

SEQ ID NO: 10783 - protein, 11 aa, Toxoplasma gondii GT1
KLFHLDSTLLA

SEQ ID NO: 10784 - protein, 9 aa, Toxoplasma gondii ME49
KLIVTSATL

SEQ ID NO: 10785 - protein, 9 aa, Toxoplasma gondii GT1
KLLADIPKA

SEQ ID NO: 10786 - protein, 10 aa, Toxoplasma gondii GT1
KLLDQIKQLK

SEQ ID NO: 10787 - protein, 12 aa, Toxoplasma gondii GT1
KLMQLLEEDTVA

SEQ ID NO: 10788 - protein, 9 aa, Mycobacterium phage Predator
KLNPMLAKA

SEQ ID NO: 10789 - protein, 12 aa, Toxoplasma gondii GT1
KVIDDVQQLEKD

SEQ ID NO: 10790 - protein, 9 aa, Enterobacteria phage RB43
KVLGLWATV

SEQ ID NO: 10791 - protein, 11 aa, Toxoplasma gondii GT1
KVVAEKGFTAA

SEQ ID NO: 10792 - protein, 9 aa, Toxoplasma gondii GT1
LALEQVADI

SEQ ID NO: 10793 - protein, 9 aa, Streptomyces phage mu1/6
LALPMPATA

SEQ ID NO: 10794 - protein, 16 aa, Toxoplasma gondii GT1
LGNPLSLSTLQDEAMQ

SEQ ID NO: 10795 - protein, 10 aa, Toxoplasma gondii GT1
LILEVQPHPS

SEQ ID NO: 10796 - protein, 11 aa, Toxoplasma gondii GT1
LILEVQPHPSV

SEQ ID NO: 10797 - protein, 9 aa, Toxoplasma gondii GT1
LLASLATSV

SEQ ID NO: 10798 - protein, 10 aa, Toxoplasma gondii GT1
LLDEHGHVRL

SEQ ID NO: 10799 - protein, 10 aa, Homo sapiens
LLGRIPSAVG

SEQ ID NO: 10800 - protein, 9 aa, Toxoplasma gondii GT1
LLLQQQQQL

SEQ ID NO: 10801 - protein, 18 aa, Toxoplasma gondii
LLTIEDGIFEVINDISTL

SEQ ID NO: 10802 - protein, 9 aa, Panine betaherpesvirus 2
LQLCCLATA

SEQ ID NO: 10803 - protein, 9 aa, Toxoplasma gondii GT1
LSLETVLNI

SEQ ID NO: 10804 - protein, 16 aa, Toxoplasma gondii
LVEGLMTTVINDISTL

SEQ ID NO: 10805 - protein, 9 aa, Spodoptera litura nucleopolyhedrovirus
LVLPILITI

SEQ ID NO: 10806 - protein, 9 aa, Enterobacteria phage VT2-Sakai
MGLPGVATV

SEQ ID NO: 10807 - protein, 9 aa, Bovine papular stomatitis virus
MGNGCLRIV

SEQ ID NO: 10808 - protein, 9 aa, Guanarito mammarenavirus
MINPLVITT

SEQ ID NO: 10809 - protein, 9 aa, Spodoptera litura nucleopolyhedrovirus II
NDFCCVATV

SEQ ID NO: 10810 - protein, 9 aa, Human metapneumovirus
NGVRVLATA

SEQ ID NO: 10811 - protein, 11 aa, Toxoplasma gondii ME49
NIQGITKPAIR

SEQ ID NO: 10812 - protein, 9 aa, Mupapillomavirus 1
NIVCPLCTL

SEQ ID NO: 10813 - protein, 10 aa, Toxoplasma gondii GT1
NLLSDLSVRL

SEQ ID NO: 10814 - protein, 14 aa, Toxoplasma gondii GT1
QFLSPVVLLDEAMQ

SEQ ID NO: 10815 - protein, 14 aa, Toxoplasma gondii ME49
QIQELIEATPYREQ

SEQ ID NO: 10816 - protein, 10 aa, Toxoplasma gondii GT1
QLNEEQKVQV

SEQ ID NO: 10817 - protein, 9 aa, Grass carp reovirus
RDVPMLITT

SEQ ID NO: 10818 - protein, 9 aa, Marek's disease herpesvirus strain GA
RGTPMVITV

SEQ ID NO: 10819 - protein, 9 aa, Toxoplasma gondii
RIINEPTAA

SEQ ID NO: 10820 - protein, 9 aa, Klebsiella phage phiKO2
RINAILATA

SEQ ID NO: 10821 - protein, 9 aa, Spodoptera frugiperda ascovirus 1a
RLNTVLATA

SEQ ID NO: 10822 - protein, 9 aa, Bovine papular stomatitis virus
RVNRLIIWV

SEQ ID NO: 10823 - protein, 9 aa, Enterobacteria phage IME08
SGDGLVATG

SEQ ID NO: 10824 - protein, 9 aa, Toxoplasma gondii
SLFDEEGAK

SEQ ID NO: 10825 - protein, 11 aa, Homo sapiens
SLFDEEGAKIV

SEQ ID NO: 10826 - protein, 11 aa, Toxoplasma gondii GT1
SLFEGIDYSVS

SEQ ID NO: 10827 - protein, 10 aa, Toxoplasma gondii ME49
SLGEWQGLTL

SEQ ID NO: 10828 - protein, 11 aa, Toxoplasma gondii GT1
SLLEHTDVAVM

SEQ ID NO: 10829 - protein, 17 aa, Toxoplasma gondii ME49
SLLGVDAVEKQLDEAMQ

SEQ ID NO: 10830 - protein, 19 aa, Toxoplasma gondii
SLLTIEDGIFEVINDISTL

SEQ ID NO: 10831 - protein, 9 aa, Toxoplasma gondii GT1
SLMTKGPST

SEQ ID NO: 10832 - protein, 12 aa, Toxoplasma gondii GT1
SLMTKGPSTQPM

SEQ ID NO: 10833 - protein, 12 aa, Toxoplasma gondii ME49
SLQDIIAILGMD

SEQ ID NO: 10834 - protein, 10 aa, Toxoplasma gondii GT1
SLQEDSIAKM

SEQ ID NO: 10835 - protein, 10 aa, Toxoplasma gondii ME49
TIMPKDIQLA

SEQ ID NO: 10836 - protein, 11 aa, Toxoplasma gondii GT1
TLLAAVRGEAA

SEQ ID NO: 10837 - protein, 9 aa, Toxoplasma gondii GT1
TLVEALDTM

SEQ ID NO: 10838 - protein, 10 aa, Toxoplasma gondii GT1
TLVEALDTME

SEQ ID NO: 10839 - protein, 12 aa, Toxoplasma gondii GT1
TLVEALDTMEAP

SEQ ID NO: 10840 - protein, 9 aa, Toxoplasma gondii GT1
TMLELLNQL

SEQ ID NO: 10841 - protein, 11 aa, Toxoplasma gondii ME49
TMLELLNQLDG

SEQ ID NO: 10842 - protein, 9 aa, Toxoplasma gondii GT1
TVVEIRNFL

SEQ ID NO: 10843 - protein, 11 aa, Toxoplasma gondii ME49
TVVPGGDLAKV

SEQ ID NO: 10844 - protein, 11 aa, Toxoplasma gondii GT1
VFLLLAPAPTF

SEQ ID NO: 10845 - protein, 9 aa, Homo sapiens
VLATLLNNL

SEQ ID NO: 10846 - protein, 11 aa, Toxoplasma gondii GT1
VLEEWLDTYAG

SEQ ID NO: 10847 - protein, 10 aa, Toxoplasma gondii ME49
VTIMPKDIQL

SEQ ID NO: 10848 - protein, 11 aa, Toxoplasma gondii ME49
VTIMPKDIQLA

SEQ ID NO: 10849 - protein, 10 aa, Toxoplasma gondii GT1
VTLSAHPLTL

SEQ ID NO: 10850 - protein, 12 aa, Toxoplasma gondii GT1
YLALPPHIFAPA

SEQ ID NO: 10851 - protein, 10 aa, Toxoplasma gondii GT1
YLDEGKVIKA

SEQ ID NO: 10852 - protein, 12 aa, Toxoplasma gondii GT1
YLFKEGVIVVQK

SEQ ID NO: 10853 - protein, 9 aa, Toxoplasma gondii ME49
YLGDGPKLV

SEQ ID NO: 10854 - protein, 9 aa, Toxoplasma gondii GT1
YLGKEVKEA

SEQ ID NO: 10855 - protein, 8 aa, Homo sapiens
YLGKTVQV

SEQ ID NO: 10856 - protein, 9 aa, Toxoplasma gondii GT1
YLLTAPVKA

SEQ ID NO: 10857 - protein, 12 aa, Toxoplasma gondii ME49
YLTAEVLELAGN

SEQ ID NO: 10858 - protein, 10 aa, Toxoplasma gondii GT1
YLYETPLETR

SEQ ID NO: 10859 - protein, 11 aa, Homo sapiens
YNFEKPFLWLA

SEQ ID NO: 10860 - protein, 9 aa, Homo sapiens
GLAARMSQV

SEQ ID NO: 10861 - protein, 9 aa, Homo sapiens
LLPPQPALA

SEQ ID NO: 10862 - protein, 9 aa, Homo sapiens
NLLEQFILL

SEQ ID NO: 10863 - protein, 9 aa, Homo sapiens
RMDGAVTSV

SEQ ID NO: 10864 - protein, 9 aa, Homo sapiens
RQLAKIHAI

SEQ ID NO: 10865 - protein, 9 aa, Homo sapiens
RVMEYINRL

SEQ ID NO: 10866 - protein, 9 aa, Homo sapiens
DLILELLDL

SEQ ID NO: 10867 - protein, 9 aa, Homo sapiens
ELAGIGILT

SEQ ID NO: 10868 - protein, 9 aa, Homo sapiens
FLLFIFKVA

SEQ ID NO: 10869 - protein, 9 aa, Homo sapiens
KLQQKEEQL

SEQ ID NO: 10870 - protein, 9 aa, Homo sapiens
KTVDLILEL

SEQ ID NO: 10871 - protein, 9 aa, Homo sapiens
LLQEEEEEL

SEQ ID NO: 10872 - protein, 9 aa, Homo sapiens
NLLEREFGA

SEQ ID NO: 10873 - protein, 9 aa, Homo sapiens
VLRKEEEKL

SEQ ID NO: 10874 - protein, 9 aa, Homo sapiens
AILASLTVI

SEQ ID NO: 10875 - protein, 9 aa, Homo sapiens
ALADIAVGV

SEQ ID NO: 10876 - protein, 8 aa, Homo sapiens
ALGTAAAL

SEQ ID NO: 10877 - protein, 10 aa, Homo sapiens
  misc_feature (9)..(9): Xaa can be any naturally occurring amino acid
ALPFVLLMXM

SEQ ID NO: 10878 - protein, 9 aa, Homo sapiens
ALVALTLVA

SEQ ID NO: 10879 - protein, 10 aa, Homo sapiens
ALVFAGGIGQ

SEQ ID NO: 10880 - protein, 10 aa, Homo sapiens
ATSSPPNDIS

SEQ ID NO: 10881 - protein, 10 aa, Homo sapiens
CEWVLVAPAG

SEQ ID NO: 10882 - protein, 13 aa, Homo sapiens
  misc_feature (12)..(12): Xaa can be any naturally occurring amino acid
DIAIDDLSFMDXM

SEQ ID NO: 10883 - protein, 9 aa, Homo sapiens
DLAQIIEAC

SEQ ID NO: 10884 - protein, 8 aa, Homo sapiens
DRAFLIEP

SEQ ID NO: 10885 - protein, 9 aa, Homo sapiens
ELCPLAEEL

SEQ ID NO: 10886 - protein, 9 aa, Homo sapiens
ETLLTAIAV

SEQ ID NO: 10887 - protein, 8 aa, Homo sapiens
EVWAAIPM

SEQ ID NO: 10888 - protein, 12 aa, Homo sapiens
FILLGFFGRWEL

SEQ ID NO: 10889 - protein, 8 aa, Homo sapiens
FLLERRLT

SEQ ID NO: 10890 - protein, 9 aa, Homo sapiens
FLLGNLSFL

SEQ ID NO: 10891 - protein, 9 aa, Homo sapiens
FPLPLLKRV

SEQ ID NO: 10892 - protein, 9 aa, Homo sapiens
GLLVLYILL

SEQ ID NO: 10893 - protein, 9 aa, Homo sapiens
GVSAWLNHL

SEQ ID NO: 10894 - protein, 11 aa, Homo sapiens
HLVDEAHCLRL

SEQ ID NO: 10895 - protein, 9 aa, Homo sapiens
HVPEHAVVL

SEQ ID NO: 10896 - protein, 9 aa, Homo sapiens
IKQKLILLQ

SEQ ID NO: 10897 - protein, 9 aa, Homo sapiens
ILEERSLLV

SEQ ID NO: 10898 - protein, 9 aa, Homo sapiens
ILLDVKTRL

SEQ ID NO: 10899 - protein, 10 aa, Homo sapiens
ISLEVDTGRT

SEQ ID NO: 10900 - protein, 8 aa, Homo sapiens
ITGVVITL

SEQ ID NO: 10901 - protein, 9 aa, Homo sapiens
ITLIIMGIV

SEQ ID NO: 10902 - protein, 10 aa, Homo sapiens
IVSRITQYIA

SEQ ID NO: 10903 - protein, 8 aa, Homo sapiens
KIEDGKAV

SEQ ID NO: 10904 - protein, 12 aa, Homo sapiens
  misc_feature (10)..(10): Xaa can be any naturally occurring amino acid
KIMHEIMYKXMM

SEQ ID NO: 10905 - protein, 11 aa, Homo sapiens
  misc_feature (10)..(10): Xaa can be any naturally occurring amino acid
KIYRSMAYEXM

SEQ ID NO: 10906 - protein, 9 aa, Homo sapiens
KLDLTLEIQ

SEQ ID NO: 10907 - protein, 10 aa, Homo sapiens
KLERVEGAAV

SEQ ID NO: 10908 - protein, 11 aa, Homo sapiens
KLLASDAEALS

SEQ ID NO: 10909 - protein, 9 aa, Homo sapiens
KLLSVLAQV

SEQ ID NO: 10910 - protein, 8 aa, Homo sapiens
KLQLLAVV

SEQ ID NO: 10911 - protein, 12 aa, Homo sapiens
  misc_feature (10)..(10): Xaa can be any naturally occurring amino acid
KMRLLNILMXMM

SEQ ID NO: 10912 - protein, 9 aa, Homo sapiens
KQDLITCLE

SEQ ID NO: 10913 - protein, 10 aa, Homo sapiens
KRVLLYVRKE

SEQ ID NO: 10914 - protein, 10 aa, Homo sapiens
KYLIGELVSS

SEQ ID NO: 10915 - protein, 9 aa, Homo sapiens
LADPENRQL

SEQ ID NO: 10916 - protein, 9 aa, Homo sapiens
LISDPVLLV

SEQ ID NO: 10917 - protein, 10 aa, Homo sapiens
LKFNKIVHSS

SEQ ID NO: 10918 - protein, 10 aa, Homo sapiens
LLDKVADNLA

SEQ ID NO: 10919 - protein, 11 aa, Homo sapiens
  misc_feature (10)..(10): Xaa can be any naturally occurring amino acid
LLMDTFFQIXM

SEQ ID NO: 10920 - protein, 9 aa, Homo sapiens
LLPPPTLGP

SEQ ID NO: 10921 - protein, 9 aa, Homo sapiens
LLSAKLPEL

SEQ ID NO: 10922 - protein, 8 aa, Homo sapiens
LLTDLKEQ

SEQ ID NO: 10923 - protein, 11 aa, Homo sapiens
  misc_feature (10)..(10): Xaa can be any naturally occurring amino acid
LMRGEPFASXM

SEQ ID NO: 10924 - protein, 8 aa, Homo sapiens
LSLNSLLP

SEQ ID NO: 10925 - protein, 9 aa, Homo sapiens
MIIVGLSVV

SEQ ID NO: 10926 - protein, 11 aa, Homo sapiens
  misc_feature (10)..(10): Xaa can be any naturally occurring amino acid
MITGTLILIXM

SEQ ID NO: 10927 - protein, 12 aa, Homo sapiens
MLMPKKNRIAIY

SEQ ID NO: 10928 - protein, 10 aa, Homo sapiens
MRYVASYLLA

SEQ ID NO: 10929 - protein, 11 aa, Homo sapiens
  misc_feature (10)..(10): Xaa can be any naturally occurring amino acid
MSGEKLVAIXM

SEQ ID NO: 10930 - protein, 9 aa, Homo sapiens
MVIQIQPPN

SEQ ID NO: 10931 - protein, 10 aa, Homo sapiens
NIDALKVINK

SEQ ID NO: 10932 - protein, 10 aa, Homo sapiens
  misc_feature (9)..(9): Xaa can be any naturally occurring amino acid
NIMSVVGVXM

SEQ ID NO: 10933 - protein, 9 aa, Homo sapiens
NLSEETNIV

SEQ ID NO: 10934 - protein, 10 aa, Homo sapiens
NTAEGTAFRL

SEQ ID NO: 10935 - protein, 8 aa, Homo sapiens
NTGIATTI

SEQ ID NO: 10936 - protein, 8 aa, Homo sapiens
PLEVNLAI

SEQ ID NO: 10937 - protein, 9 aa, Homo sapiens
PLVSVVDTI

SEQ ID NO: 10938 - protein, 11 aa, Homo sapiens
PNKLVELNKLF

SEQ ID NO: 10939 - protein, 9 aa, Homo sapiens
PVLDIKPYI

SEQ ID NO: 10940 - protein, 8 aa, Homo sapiens
PWNLVALS

SEQ ID NO: 10941 - protein, 9 aa, Homo sapiens
QGIAILAVV

SEQ ID NO: 10942 - protein, 9 aa, Homo sapiens
QIELLKELL

SEQ ID NO: 10943 - protein, 8 aa, Homo sapiens
QIGIVAVV

SEQ ID NO: 10944 - protein, 8 aa, Homo sapiens
QKWVELTD

SEQ ID NO: 10945 - protein, 10 aa, Homo sapiens
QLLSALQSLV

SEQ ID NO: 10946 - protein, 8 aa, Homo sapiens
QLPSDVGL

SEQ ID NO: 10947 - protein, 9 aa, Homo sapiens
QMKLDDICL

SEQ ID NO: 10948 - protein, 10 aa, Homo sapiens
QNMPETLPNN

SEQ ID NO: 10949 - protein, 9 aa, Homo sapiens
QQVQAPVEL

SEQ ID NO: 10950 - protein, 12 aa, Homo sapiens
  misc_feature (11)..(11): Xaa can be any naturally occurring amino acid
QSATVFMSEVXM

SEQ ID NO: 10951 - protein, 8 aa, Homo sapiens
QVDPEFLG

SEQ ID NO: 10952 - protein, 10 aa, Homo sapiens
RGVDLDQLLD

SEQ ID NO: 10953 - protein, 9 aa, Homo sapiens
RLSQELPEV

SEQ ID NO: 10954 - protein, 11 aa, Homo sapiens
RRKKKITDVLA

SEQ ID NO: 10955 - protein, 11 aa, Homo sapiens
SFLPEKSGYPD

SEQ ID NO: 10956 - protein, 9 aa, Homo sapiens
SIAEGRISL

SEQ ID NO: 10957 - protein, 8 aa, Homo sapiens
SISWDDRV

SEQ ID NO: 10958 - protein, 9 aa, Homo sapiens
SLCPDLMEI

SEQ ID NO: 10959 - protein, 10 aa, Homo sapiens
SLNTWLILCS

SEQ ID NO: 10960 - protein, 9 aa, Homo sapiens
TGPVATEVV

SEQ ID NO: 10961 - protein, 9 aa, Homo sapiens
TLLAGITGV

SEQ ID NO: 10962 - protein, 12 aa, Homo sapiens
  misc_feature (11)..(11): Xaa can be any naturally occurring amino acid
TTGVSVIMNTXM

SEQ ID NO: 10963 - protein, 8 aa, Homo sapiens
VEKLLVLD

SEQ ID NO: 10964 - protein, 9 aa, Homo sapiens
VISQGKIVL

SEQ ID NO: 10965 - protein, 10 aa, Homo sapiens
VLLSGTIRFN

SEQ ID NO: 10966 - protein, 9 aa, Homo sapiens
VPGAVLVFL

SEQ ID NO: 10967 - protein, 9 aa, Homo sapiens
YAIEVDPVL

SEQ ID NO: 10968 - protein, 11 aa, Homo sapiens
YILTTGLIPVL

SEQ ID NO: 10969 - protein, 11 aa, Homo sapiens
  misc_feature (10)..(10): Xaa can be any naturally occurring amino acid
YIMGYISKVXM

SEQ ID NO: 10970 - protein, 9 aa, Homo sapiens
YYDGKMVQL

SEQ ID NO: 10971 - protein, 10 aa, Homo sapiens
AQWGPDPAAA

SEQ ID NO: 10972 - protein, 10 aa, Bacteroides fragilis
MVWGPDPLYV

SEQ ID NO: 10973 - protein, 10 aa, Homo sapiens
RQFGPDFPTI

SEQ ID NO: 10974 - protein, 10 aa, [Clostridium] asparagiforme
RQFGPDWIVA

SEQ ID NO: 10975 - protein, 10 aa, Homo sapiens
YLGGPDFPTI

SEQ ID NO: 10976 - protein, 10 aa, Homo sapiens
YQFGPDFPIA

SEQ ID NO: 10977 - protein, 9 aa, Human adenovirus 31
ILHTNMPNV

SEQ ID NO: 10978 - protein, 9 aa, Hepatitis C virus
CINGVFWTV

SEQ ID NO: 10979 - protein, 9 aa, Hepatitis C virus
CLNGVCWTV

SEQ ID NO: 10980 - protein, 10 aa, Hepatitis C virus
KLLALGINAV

SEQ ID NO: 10981 - protein, 10 aa, Hepatitis C virus
KLSSLGLNSV

SEQ ID NO: 10982 - protein, 10 aa, Hepatitis C virus
KLTALGINAV

SEQ ID NO: 10983 - protein, 10 aa, Hepatitis C virus
KLVALGNNAV

SEQ ID NO: 10984 - protein, 10 aa, Hepatitis C virus
KLVTLGINAV

SEQ ID NO: 10985 - protein, 9 aa, Homo sapiens
ALDILITNV

SEQ ID NO: 10986 - protein, 11 aa, Homo sapiens
ALDRQTATQLL

SEQ ID NO: 10987 - protein, 12 aa, Homo sapiens
ALIDGSREGFYL

SEQ ID NO: 10988 - protein, 9 aa, Homo sapiens
ALLAELEKI

SEQ ID NO: 10989 - protein, 10 aa, Homo sapiens
ALLERASATL

SEQ ID NO: 10990 - protein, 9 aa, Homo sapiens
ALQDSNNKL

SEQ ID NO: 10991 - protein, 9 aa, Homo sapiens
ALSELTQGV

SEQ ID NO: 10992 - protein, 9 aa, Homo sapiens
ALTDIDLQL

SEQ ID NO: 10993 - protein, 9 aa, Homo sapiens
ALTDKAIVK

SEQ ID NO: 10994 - protein, 12 aa, Homo sapiens
AMLGTHTMEVTV

SEQ ID NO: 10995 - protein, 9 aa, Homo sapiens
AQYGKVIDR

SEQ ID NO: 10996 - protein, 9 aa, Homo sapiens
ELSDVLIYL

SEQ ID NO: 10997 - protein, 11 aa, Homo sapiens
FLPPEHTIVYI

SEQ ID NO: 10998 - protein, 10 aa, Homo sapiens
GTMDMSITRL

SEQ ID NO: 10999 - protein, 12 aa, Homo sapiens
GVYDIDNKTIEL

SEQ ID NO: 11000 - protein, 9 aa, Homo sapiens
HVDSTLLQV

SEQ ID NO: 11001 - protein, 10 aa, Homo sapiens
HVFDHPWETV

SEQ ID NO: 11002 - protein, 9 aa, Homo sapiens
HVITKTMEL

SEQ ID NO: 11003 - protein, 9 aa, Homo sapiens
KIFEDIPTL

SEQ ID NO: 11004 - protein, 12 aa, Homo sapiens
KIWDLKERTNVA

SEQ ID NO: 11005 - protein, 12 aa, Homo sapiens
KLLNVDPDNVVL

SEQ ID NO: 11006 - protein, 9 aa, Homo sapiens
KLQEENHQL

SEQ ID NO: 11007 - protein, 11 aa, Homo sapiens
KMDDPTVNWSI

SEQ ID NO: 11008 - protein, 9 aa, Homo sapiens
KMQEDLVTL

SEQ ID NO: 11009 - protein, 11 aa, Homo sapiens
KMYGYVDTLLT

SEQ ID NO: 11010 - protein, 9 aa, Homo sapiens
KQDFSVPQL

SEQ ID NO: 11011 - protein, 8 aa, Homo sapiens
KQDILYLH

SEQ ID NO: 11012 - protein, 10 aa, Homo sapiens
KTMEDTLMTV

SEQ ID NO: 11013 - protein, 12 aa, Homo sapiens
KTWDQVPFSVSV

SEQ ID NO: 11014 - protein, 9 aa, Homo sapiens
KTWNAVLLR

SEQ ID NO: 11015 - protein, 10 aa, Homo sapiens
KVLGKGSFGK

SEQ ID NO: 11016 - protein, 10 aa, Homo sapiens
LLFERELHSV

SEQ ID NO: 11017 - protein, 9 aa, Homo sapiens
MIRKEELEI

SEQ ID NO: 11018 - protein, 11 aa, Homo sapiens
NLFEWAKNSPL

SEQ ID NO: 11019 - protein, 11 aa, Homo sapiens
NLMNNPQIQQL

SEQ ID NO: 11020 - protein, 11 aa, Homo sapiens
NLWDLTDASVV

SEQ ID NO: 11021 - protein, 9 aa, Homo sapiens
NMAEGFRTV

SEQ ID NO: 11022 - protein, 9 aa, Homo sapiens
QLWEKAQRL

SEQ ID NO: 11023 - protein, 9 aa, Homo sapiens
QQQQQQQQF

SEQ ID NO: 11024 - protein, 9 aa, Homo sapiens
RIDITLSSV

SEQ ID NO: 11025 - protein, 9 aa, Homo sapiens
RIDLIPSLY

SEQ ID NO: 11026 - protein, 9 aa, Homo sapiens
RILDESHSI

SEQ ID NO: 11027 - protein, 9 aa, Homo sapiens
RLDQLLRHV

SEQ ID NO: 11028 - protein, 9 aa, Homo sapiens
RLDQVIRQR

SEQ ID NO: 11029 - protein, 11 aa, Homo sapiens
RLFNDPVAMVL

SEQ ID NO: 11030 - protein, 9 aa, Homo sapiens
RLLDKWVEL

SEQ ID NO: 11031 - protein, 9 aa, Homo sapiens
RLLELETRL

SEQ ID NO: 11032 - protein, 9 aa, Homo sapiens
RLLKSKLYL

SEQ ID NO: 11033 - protein, 9 aa, Homo sapiens
RLNDFASTV

SEQ ID NO: 11034 - protein, 10 aa, Homo sapiens
RLPDIPLRQV

SEQ ID NO: 11035 - protein, 10 aa, Homo sapiens
RLYDEKQQHI

SEQ ID NO: 11036 - protein, 8 aa, Homo sapiens
RLYQAIQR

SEQ ID NO: 11037 - protein, 11 aa, Homo sapiens
RQLGSKYILGI

SEQ ID NO: 11038 - protein, 9 aa, Homo sapiens
RQVTGVTRV

SEQ ID NO: 11039 - protein, 11 aa, Homo sapiens
RVMEEIRNLTV

SEQ ID NO: 11040 - protein, 11 aa, Homo sapiens
SLAERVDRLQV

SEQ ID NO: 11041 - protein, 9 aa, Homo sapiens
SLDGFTIQV

SEQ ID NO: 11042 - protein, 9 aa, Homo sapiens
SLINNPAFI

SEQ ID NO: 11043 - protein, 9 aa, Homo sapiens
SLLEERFRV

SEQ ID NO: 11044 - protein, 10 aa, Homo sapiens
SVAVLRGIQK

SEQ ID NO: 11045 - protein, 12 aa, Homo sapiens
SVMEVNSGIYRV

SEQ ID NO: 11046 - protein, 9 aa, Homo sapiens
THFPDETEI

SEQ ID NO: 11047 - protein, 9 aa, Homo sapiens
TVLEQVLPI

SEQ ID NO: 11048 - protein, 11 aa, Homo sapiens
VLWSDSSITSV

SEQ ID NO: 11049 - protein, 8 aa, Homo sapiens
VMAPRTLL

SEQ ID NO: 11050 - protein, 9 aa, Homo sapiens
VMLDKQKEL

SEQ ID NO: 11051 - protein, 9 aa, Homo sapiens
WLLDNVRKV

SEQ ID NO: 11052 - protein, 11 aa, Homo sapiens
YIMEPSIFNTL

SEQ ID NO: 11053 - protein, 11 aa, Homo sapiens
YLINEIDRIRA

SEQ ID NO: 11054 - protein, 11 aa, Homo sapiens
YLINNPNQISL

SEQ ID NO: 11055 - protein, 9 aa, Homo sapiens
IMPGQEAGL

SEQ ID NO: 11056 - protein, 9 aa, Homo sapiens
QILKGGSGT

SEQ ID NO: 11057 - protein, 9 aa, Homo sapiens
QLIMPGQEA

SEQ ID NO: 11058 - protein, 9 aa, Homo sapiens
SLAVVSTQL

SEQ ID NO: 11059 - protein, 9 aa, Homo sapiens
SSADVEFCL

SEQ ID NO: 11060 - protein, 9 aa, Homo sapiens
VIMPCSWWV

SEQ ID NO: 11061 - protein, 8 aa, Homo sapiens
AIRNDEEL

SEQ ID NO: 11062 - protein, 9 aa, Homo sapiens
FLLEREQLL

SEQ ID NO: 11063 - protein, 9 aa, Homo sapiens
IIADNIIFL

SEQ ID NO: 11064 - protein, 9 aa, Homo sapiens
RIFAPNHVV

SEQ ID NO: 11065 - protein, 9 aa, Homo sapiens
RIHPVSTMV

SEQ ID NO: 11066 - protein, 9 aa, Homo sapiens
RILDILEYI

SEQ ID NO: 11067 - protein, 9 aa, Homo sapiens
RISPWLLRV

SEQ ID NO: 11068 - protein, 9 aa, Homo sapiens
YLNDLHEVL

SEQ ID NO: 11069 - protein, 9 aa, Homo sapiens
YVHMVTHFI

SEQ ID NO: 11070 - protein, 9 aa, Homo sapiens
ILAKFLHEL

SEQ ID NO: 11071 - protein, 9 aa, Homo sapiens
ILAKFLHRL

SEQ ID NO: 11072 - protein, 9 aa, Homo sapiens
ILAKFLHTL

SEQ ID NO: 11073 - protein, 9 aa, Homo sapiens
ILGKFLHRL

SEQ ID NO: 11074 - protein, 9 aa, Homo sapiens
ILGKFLHTL

SEQ ID NO: 11075 - protein, 9 aa, Homo sapiens
ILGKFLHWL

SEQ ID NO: 11076 - protein, 9 aa, Homo sapiens
AAFAHFPEL

SEQ ID NO: 11077 - protein, 9 aa, Homo sapiens
AALKLPLLV

SEQ ID NO: 11078 - protein, 9 aa, Homo sapiens
AALSKIFAV

SEQ ID NO: 11079 - protein, 9 aa, Homo sapiens
AAMSVAQRV

SEQ ID NO: 11080 - protein, 11 aa, Homo sapiens
AIAPCEVTVPA

SEQ ID NO: 11081 - protein, 9 aa, Homo sapiens
AIFAIPLQI

SEQ ID NO: 11082 - protein, 9 aa, Homo sapiens
AIYPEPFLI

SEQ ID NO: 11083 - protein, 9 aa, Homo sapiens
ALASLVQHI

SEQ ID NO: 11084 - protein, 9 aa, Homo sapiens
ALDCSEVTV

SEQ ID NO: 11085 - protein, 9 aa, Homo sapiens
ALDEICFKV

SEQ ID NO: 11086 - protein, 9 aa, Homo sapiens
ALDEQLVQV

SEQ ID NO: 11087 - protein, 9 aa, Homo sapiens
ALDVSPKHV

SEQ ID NO: 11088 - protein, 9 aa, Homo sapiens
ALGAVSQRI

SEQ ID NO: 11089 - protein, 8 aa, Homo sapiens
ALGLLYHV

SEQ ID NO: 11090 - protein, 10 aa, Homo sapiens
ALIDEQILCV

SEQ ID NO: 11091 - protein, 9 aa, Homo sapiens
ALIGQCIHI

SEQ ID NO: 11092 - protein, 9 aa, Homo sapiens
ALKEGDVTI

SEQ ID NO: 11093 - protein, 9 aa, Homo sapiens
ALLDCANKV

SEQ ID NO: 11094 - protein, 10 aa, Homo sapiens
ALLEDSCHYL

SEQ ID NO: 11095 - protein, 11 aa, Homo sapiens
ALLGAGCDPEL

SEQ ID NO: 11096 - protein, 9 aa, Homo sapiens
ALLKKLQHA

SEQ ID NO: 11097 - protein, 9 aa, Homo sapiens
ALLNGEYLL

SEQ ID NO: 11098 - protein, 10 aa, Homo sapiens
ALMAGCIQEA

SEQ ID NO: 11099 - protein, 9 aa, Homo sapiens
ALNDCIYSV

SEQ ID NO: 11100 - protein, 10 aa, Homo sapiens
ALNPAALTAL

SEQ ID NO: 11101 - protein, 9 aa, Homo sapiens
ALNRLFQQI

SEQ ID NO: 11102 - protein, 9 aa, Homo sapiens
ALPQIAAKI

SEQ ID NO: 11103 - protein, 10 aa, Homo sapiens
ALQDVPLSSV

SEQ ID NO: 11104 - protein, 9 aa, Homo sapiens
ALRPPLPPL

SEQ ID NO: 11105 - protein, 9 aa, Homo sapiens
ALSLVSCKL

SEQ ID NO: 11106 - protein, 10 aa, Homo sapiens
ALSPITKLSV

SEQ ID NO: 11107 - protein, 9 aa, Homo sapiens
ALSQLVPCV

SEQ ID NO: 11108 - protein, 9 aa, Homo sapiens
ALTSIAQKI

SEQ ID NO: 11109 - protein, 10 aa, Homo sapiens
ALVDGPCTQV

SEQ ID NO: 11110 - protein, 9 aa, Homo sapiens
ALYGHTQAV

SEQ ID NO: 11111 - protein, 9 aa, Homo sapiens
ALYTLVNKV

SEQ ID NO: 11112 - protein, 9 aa, Homo sapiens
AMLKEVCTA

SEQ ID NO: 11113 - protein, 9 aa, Homo sapiens
AMQEYIAVV

SEQ ID NO: 11114 - protein, 9 aa, Homo sapiens
AQFKGTQSL

SEQ ID NO: 11115 - protein, 9 aa, Homo sapiens
AQHPNIVTV

SEQ ID NO: 11116 - protein, 9 aa, Homo sapiens
AQIDHYLGL

SEQ ID NO: 11117 - protein, 9 aa, Homo sapiens
AQITQKIGV

SEQ ID NO: 11118 - protein, 8 aa, Homo sapiens
AQLKQWLV

SEQ ID NO: 11119 - protein, 9 aa, Homo sapiens
AQLPMSIRI

SEQ ID NO: 11120 - protein, 9 aa, Homo sapiens
AQNDLIWNI

SEQ ID NO: 11121 - protein, 9 aa, Homo sapiens
AQSGFPLRV

SEQ ID NO: 11122 - protein, 9 aa, Homo sapiens
AQVPVFLAL

SEQ ID NO: 11123 - protein, 9 aa, Homo sapiens
AQYFEPLTL

SEQ ID NO: 11124 - protein, 10 aa, Homo sapiens
ATLGAILNRL

SEQ ID NO: 11125 - protein, 9 aa, Homo sapiens
AVHNVPLSV

SEQ ID NO: 11126 - protein, 9 aa, Homo sapiens
AVIHEAPAV

SEQ ID NO: 11127 - protein, 11 aa, Homo sapiens
AVLDGADCIML

SEQ ID NO: 11128 - protein, 9 aa, Homo sapiens
AVMACRNEV

SEQ ID NO: 11129 - protein, 9 aa, Homo sapiens
AVSAAVQAV

SEQ ID NO: 11130 - protein, 9 aa, Homo sapiens
FAQEALTVL

SEQ ID NO: 11131 - protein, 9 aa, Homo sapiens
FATKVVHLL

SEQ ID NO: 11132 - protein, 9 aa, Homo sapiens
FAVPKNYKL

SEQ ID NO: 11133 - protein, 9 aa, Homo sapiens
FIDEAGHCM

SEQ ID NO: 11134 - protein, 9 aa, Homo sapiens
FIISRTQAL

SEQ ID NO: 11135 - protein, 9 aa, Homo sapiens
FIMDNCEEL

SEQ ID NO: 11136 - protein, 9 aa, Homo sapiens
FIMDSCDEL

SEQ ID NO: 11137 - protein, 9 aa, Homo sapiens
FIPATGHSL

SEQ ID NO: 11138 - protein, 9 aa, Homo sapiens
FISGHTSEL

SEQ ID NO: 11139 - protein, 9 aa, Homo sapiens
FITNIPFDV

SEQ ID NO: 11140 - protein, 9 aa, Homo sapiens
FLDNACHQL

SEQ ID NO: 11141 - protein, 10 aa, Homo sapiens
FLDPYCSASV

SEQ ID NO: 11142 - protein, 9 aa, Homo sapiens
FLDSLIYGA

SEQ ID NO: 11143 - protein, 9 aa, Homo sapiens
FLEEANRVL

SEQ ID NO: 11144 - protein, 11 aa, Homo sapiens
FLFDCPGQVEL

SEQ ID NO: 11145 - protein, 9 aa, Homo sapiens
FLFPNKESL

SEQ ID NO: 11146 - protein, 9 aa, Homo sapiens
FLFTTPCRL

SEQ ID NO: 11147 - protein, 8 aa, Homo sapiens
FLGRVLEA

SEQ ID NO: 11148 - protein, 9 aa, Homo sapiens
FLGSILTAV

SEQ ID NO: 11149 - protein, 9 aa, Homo sapiens
FLIDNGVSL

SEQ ID NO: 11150 - protein, 9 aa, Homo sapiens
FLIEEQKIV

SEQ ID NO: 11151 - protein, 9 aa, Homo sapiens
FLKKQIPAI

SEQ ID NO: 11152 - protein, 10 aa, Homo sapiens
FLKQGEDHCL

SEQ ID NO: 11153 - protein, 9 aa, Homo sapiens
FLLKSCPLL

SEQ ID NO: 11154 - protein, 9 aa, Homo sapiens
FLLPTLRKV

SEQ ID NO: 11155 - protein, 9 aa, Homo sapiens
FLMGPIECL

SEQ ID NO: 11156 - protein, 9 aa, Homo sapiens
FLNHCLEHL

SEQ ID NO: 11157 - protein, 9 aa, Homo sapiens
FLPGISTAL

SEQ ID NO: 11158 - protein, 10 aa, Homo sapiens
FLPTRALAAL

SEQ ID NO: 11159 - protein, 9 aa, Homo sapiens
FLQPNRQFL

SEQ ID NO: 11160 - protein, 9 aa, Homo sapiens
FLSPDKLSL

SEQ ID NO: 11161 - protein, 9 aa, Homo sapiens
FLYIRQLAI

SEQ ID NO: 11162 - protein, 9 aa, Homo sapiens
FLYTFCHHL

SEQ ID NO: 11163 - protein, 9 aa, Homo sapiens
FMADCPHTI

SEQ ID NO: 11164 - protein, 9 aa, Homo sapiens
FMNSSIQCV

SEQ ID NO: 11165 - protein, 9 aa, Homo sapiens
FQMEQIVYC

SEQ ID NO: 11166 - protein, 9 aa, Homo sapiens
FQNNAIHYI

SEQ ID NO: 11167 - protein, 9 aa, Homo sapiens
FQTSHTLHL

SEQ ID NO: 11168 - protein, 9 aa, Homo sapiens
FTDPCNYQL

SEQ ID NO: 11169 - protein, 8 aa, Homo sapiens
FTGAPLKV

SEQ ID NO: 11170 - protein, 9 aa, Homo sapiens
FTLSHITQL

SEQ ID NO: 11171 - protein, 10 aa, Homo sapiens
FVADEGICYL

SEQ ID NO: 11172 - protein, 9 aa, Homo sapiens
FVDEGIKTL

SEQ ID NO: 11173 - protein, 9 aa, Homo sapiens
FVLPCIQQI

SEQ ID NO: 11174 - protein, 9 aa, Homo sapiens
FVSPLVKYL

SEQ ID NO: 11175 - protein, 9 aa, Homo sapiens
FVTSSHLQL

SEQ ID NO: 11176 - protein, 9 aa, Homo sapiens
GLADCLLYL

SEQ ID NO: 11177 - protein, 9 aa, Homo sapiens
GLAFVPLQI

SEQ ID NO: 11178 - protein, 9 aa, Homo sapiens
GLAPPQHLI

SEQ ID NO: 11179 - protein, 10 aa, Homo sapiens
GLARCSLVNV

SEQ ID NO: 11180 - protein, 9 aa, Homo sapiens
GLDEAIRKV

SEQ ID NO: 11181 - protein, 9 aa, Homo sapiens
GLDIPHCNV

SEQ ID NO: 11182 - protein, 11 aa, Homo sapiens
GLDPSTPAQVI

SEQ ID NO: 11183 - protein, 9 aa, Homo sapiens
GLGPWVPLA

SEQ ID NO: 11184 - protein, 10 aa, Homo sapiens
GLIIRKPVTV

SEQ ID NO: 11185 - protein, 9 aa, Homo sapiens
GLLDCPIFL

SEQ ID NO: 11186 - protein, 10 aa, Homo sapiens
GLLDLPDASV

SEQ ID NO: 11187 - protein, 9 aa, Homo sapiens
GLLEFLRPA

SEQ ID NO: 11188 - protein, 9 aa, Homo sapiens
GLLENSPHL

SEQ ID NO: 11189 - protein, 9 aa, Homo sapiens
GLNSIVHKA

SEQ ID NO: 11190 - protein, 9 aa, Homo sapiens
GLNTIPLFV

SEQ ID NO: 11191 - protein, 9 aa, Homo sapiens
GLYPAPLKI

SEQ ID NO: 11192 - protein, 10 aa, Homo sapiens
GLYSKTSQSV

SEQ ID NO: 11193 - protein, 9 aa, Homo sapiens
GQADPVVAV

SEQ ID NO: 11194 - protein, 9 aa, Homo sapiens
GQMGSFIRL

SEQ ID NO: 11195 - protein, 9 aa, Homo sapiens
GQSPHKFTV

SEQ ID NO: 11196 - protein, 9 aa, Homo sapiens
GQTSVVSFL

SEQ ID NO: 11197 - protein, 9 aa, Homo sapiens
GQWLWAQRL

SEQ ID NO: 11198 - protein, 9 aa, Homo sapiens
GTIGLIHAV

SEQ ID NO: 11199 - protein, 9 aa, Homo sapiens
GVAFFPLHI

SEQ ID NO: 11200 - protein, 9 aa, Homo sapiens
GVSDVELRV

SEQ ID NO: 11201 - protein, 9 aa, Homo sapiens
HAAGVLLHV

SEQ ID NO: 11202 - protein, 9 aa, Homo sapiens
HIDNNILLI

SEQ ID NO: 11203 - protein, 9 aa, Homo sapiens
HILECEFYL

SEQ ID NO: 11204 - protein, 9 aa, Homo sapiens
HLAEALEQL

SEQ ID NO: 11205 - protein, 10 aa, Homo sapiens
HLHNMPPSAL

SEQ ID NO: 11206 - protein, 9 aa, Homo sapiens
HLLKSETSV

SEQ ID NO: 11207 - protein, 9 aa, Homo sapiens
HLLPCEVAV

SEQ ID NO: 11208 - protein, 9 aa, Homo sapiens
HLLPTEQRI

SEQ ID NO: 11209 - protein, 10 aa, Homo sapiens
HLLSGQLPTI

SEQ ID NO: 11210 - protein, 9 aa, Homo sapiens
HLPPGFLHL

SEQ ID NO: 11211 - protein, 9 aa, Homo sapiens
HLSELVQQI

SEQ ID NO: 11212 - protein, 9 aa, Homo sapiens
HQLNICSKV

SEQ ID NO: 11213 - protein, 9 aa, Homo sapiens
HVSEVPVSV

SEQ ID NO: 11214 - protein, 9 aa, Homo sapiens
IIADCQVYL

SEQ ID NO: 11215 - protein, 9 aa, Homo sapiens
IIFHLGHAA

SEQ ID NO: 11216 - protein, 9 aa, Homo sapiens
IIQHSIPAV

SEQ ID NO: 11217 - protein, 9 aa, Homo sapiens
ILDDVCATM

SEQ ID NO: 11218 - protein, 9 aa, Homo sapiens
ILDKNLESV

SEQ ID NO: 11219 - protein, 9 aa, Homo sapiens
ILDPCIYRV

SEQ ID NO: 11220 - protein, 11 aa, Homo sapiens
ILFDCPGQIEL

SEQ ID NO: 11221 - protein, 9 aa, Homo sapiens
ILHDAVVFL

SEQ ID NO: 11222 - protein, 11 aa, Homo sapiens
ILIECGADVNV

SEQ ID NO: 11223 - protein, 9 aa, Homo sapiens
ILLEKEAEL

SEQ ID NO: 11224 - protein, 8 aa, Homo sapiens
ILNKALLL

SEQ ID NO: 11225 - protein, 10 aa, Homo sapiens
ILQEYVEHQV

SEQ ID NO: 11226 - protein, 9 aa, Homo sapiens
ILSDDCATL

SEQ ID NO: 11227 - protein, 9 aa, Homo sapiens
ILTAVLPCL

SEQ ID NO: 11228 - protein, 9 aa, Homo sapiens
ILTSDVPQI

SEQ ID NO: 11229 - protein, 9 aa, Homo sapiens
ILWEHCIRL

SEQ ID NO: 11230 - protein, 9 aa, Homo sapiens
ILYDSNCQL

SEQ ID NO: 11231 - protein, 9 aa, Homo sapiens
IQDFEMPTV

SEQ ID NO: 11232 - protein, 9 aa, Homo sapiens
IQDKCVPLV

SEQ ID NO: 11233 - protein, 9 aa, Homo sapiens
IQLPACLRV

SEQ ID NO: 11234 - protein, 9 aa, Homo sapiens
IQVNCPPAV

SEQ ID NO: 11235 - protein, 9 aa, Homo sapiens
IQWSIVPEV

SEQ ID NO: 11236 - protein, 8 aa, Homo sapiens
ITSKILFV

SEQ ID NO: 11237 - protein, 9 aa, Homo sapiens
IVMEQSCEL

SEQ ID NO: 11238 - protein, 9 aa, Homo sapiens
IVPEGVHAL

SEQ ID NO: 11239 - protein, 9 aa, Homo sapiens
IVSPVVAAV

SEQ ID NO: 11240 - protein, 9 aa, Homo sapiens
KIPEDVSGL

SEQ ID NO: 11241 - protein, 9 aa, Homo sapiens
KITSCIFQL

SEQ ID NO: 11242 - protein, 9 aa, Homo sapiens
KIYEGAYHV

SEQ ID NO: 11243 - protein, 9 aa, Homo sapiens
KLADICKNL

SEQ ID NO: 11244 - protein, 9 aa, Homo sapiens
KLDDCITYI

SEQ ID NO: 11245 - protein, 9 aa, Homo sapiens
KLDVQPKCV

SEQ ID NO: 11246 - protein, 9 aa, Homo sapiens
KLFVIAQKI

SEQ ID NO: 11247 - protein, 9 aa, Homo sapiens
KLIDIQEKI

SEQ ID NO: 11248 - protein, 10 aa, Homo sapiens
KLIEESCPQL

SEQ ID NO: 11249 - protein, 9 aa, Homo sapiens
KLIPNAIQI

SEQ ID NO: 11250 - protein, 9 aa, Homo sapiens
KLKEIFDKI

SEQ ID NO: 11251 - protein, 10 aa, Homo sapiens
KLLDAGDLDI

SEQ ID NO: 11252 - protein, 9 aa, Homo sapiens
KLLEEICNL

SEQ ID NO: 11253 - protein, 10 aa, Homo sapiens
KLLEGEECRI

SEQ ID NO: 11254 - protein, 10 aa, Homo sapiens
KLLEVVQPCL

SEQ ID NO: 11255 - protein, 9 aa, Homo sapiens
KLLKPSLAV

SEQ ID NO: 11256 - protein, 9 aa, Homo sapiens
KLLNIQQQL

SEQ ID NO: 11257 - protein, 10 aa, Homo sapiens
KLPEYNPRTL

SEQ ID NO: 11258 - protein, 9 aa, Homo sapiens
KLQNKEHVI

SEQ ID NO: 11259 - protein, 9 aa, Homo sapiens
KLRDLEDSL

SEQ ID NO: 11260 - protein, 9 aa, Homo sapiens
KLRECESVL

SEQ ID NO: 11261 - protein, 9 aa, Homo sapiens
KLRQLQDLV

SEQ ID NO: 11262 - protein, 9 aa, Homo sapiens
KLTELEQRI

SEQ ID NO: 11263 - protein, 9 aa, Homo sapiens
KLVDCIIEV

SEQ ID NO: 11264 - protein, 11 aa, Homo sapiens
KLWDPRTPCNA

SEQ ID NO: 11265 - protein, 9 aa, Homo sapiens
KQAFERLEV

SEQ ID NO: 11266 - protein, 9 aa, Homo sapiens
KQAGLVSKI

SEQ ID NO: 11267 - protein, 9 aa, Homo sapiens
KQFGNILIL

SEQ ID NO: 11268 - protein, 9 aa, Homo sapiens
KQGKVIIVV

SEQ ID NO: 11269 - protein, 9 aa, Homo sapiens
KQHFINQAV

SEQ ID NO: 11270 - protein, 9 aa, Homo sapiens
KQIDVYRSV

SEQ ID NO: 11271 - protein, 9 aa, Homo sapiens
KQINQEYLI

SEQ ID NO: 11272 - protein, 9 aa, Homo sapiens
KQIPAITCI

SEQ ID NO: 11273 - protein, 9 aa, Homo sapiens
KQIWQNLGL

SEQ ID NO: 11274 - protein, 10 aa, Homo sapiens
KQLASGLLLV

SEQ ID NO: 11275 - protein, 10 aa, Homo sapiens
KQLDGIHVTI

SEQ ID NO: 11276 - protein, 9 aa, Homo sapiens
KQLLHSCTV

SEQ ID NO: 11277 - protein, 9 aa, Homo sapiens
KQPAFTIHV

SEQ ID NO: 11278 - protein, 9 aa, Homo sapiens
KQTDFEHRI

SEQ ID NO: 11279 - protein, 9 aa, Homo sapiens
KQVKQFLLL

SEQ ID NO: 11280 - protein, 10 aa, Homo sapiens
KQYEGGIFKI

SEQ ID NO: 11281 - protein, 9 aa, Homo sapiens
KQYVTSLLL

SEQ ID NO: 11282 - protein, 9 aa, Homo sapiens
KTAEFLSKL

SEQ ID NO: 11283 - protein, 9 aa, Homo sapiens
KTGEHTWSL

SEQ ID NO: 11284 - protein, 9 aa, Homo sapiens
KTNHVFFLL

SEQ ID NO: 11285 - protein, 9 aa, Homo sapiens
KVADYIPQL

SEQ ID NO: 11286 - protein, 9 aa, Homo sapiens
KVVNIVPVI

SEQ ID NO: 11287 - protein, 9 aa, Homo sapiens
LAAGFQWYL

SEQ ID NO: 11288 - protein, 9 aa, Homo sapiens
LIDEQILCV

SEQ ID NO: 11289 - protein, 9 aa, Homo sapiens
LLADACWAL

SEQ ID NO: 11290 - protein, 9 aa, Homo sapiens
LLAQPGEAL

SEQ ID NO: 11291 - protein, 9 aa, Homo sapiens
LLDCDTPSV

SEQ ID NO: 11292 - protein, 9 aa, Homo sapiens
LLDGCRIYL

SEQ ID NO: 11293 - protein, 11 aa, Homo sapiens
LLDHTGGCMYI

SEQ ID NO: 11294 - protein, 9 aa, Homo sapiens
LLDKNCHLL

SEQ ID NO: 11295 - protein, 9 aa, Homo sapiens
LLDVTCKTV

SEQ ID NO: 11296 - protein, 9 aa, Homo sapiens
LLEDSCHYL

SEQ ID NO: 11297 - protein, 9 aa, Homo sapiens
LLEPCIPSV

SEQ ID NO: 11298 - protein, 9 aa, Homo sapiens
LLFEGEKKI

SEQ ID NO: 11299 - protein, 9 aa, Homo sapiens
LLHEVPHEV

SEQ ID NO: 11300 - protein, 9 aa, Homo sapiens
LLHGHIVEL

SEQ ID NO: 11301 - protein, 10 aa, Homo sapiens
LLHSLQLPEA

SEQ ID NO: 11302 - protein, 9 aa, Homo sapiens
LLKDCEAEV

SEQ ID NO: 11303 - protein, 9 aa, Homo sapiens
LLPDIVTCV

SEQ ID NO: 11304 - protein, 9 aa, Homo sapiens
LLPDLIQKV

SEQ ID NO: 11305 - protein, 9 aa, Homo sapiens
LLPTGLSSL

SEQ ID NO: 11306 - protein, 9 aa, Homo sapiens
LLQEHNNAL

SEQ ID NO: 11307 - protein, 9 aa, Homo sapiens
LLQGTLLKI

SEQ ID NO: 11308 - protein, 9 aa, Homo sapiens
LLRDYEPQL

SEQ ID NO: 11309 - protein, 9 aa, Homo sapiens
LLTVTSQLL

SEQ ID NO: 11310 - protein, 9 aa, Homo sapiens
LLVEEIHRL

SEQ ID NO: 11311 - protein, 9 aa, Homo sapiens
LLWQSLILL

SEQ ID NO: 11312 - protein, 9 aa, Homo sapiens
LLYDNVPGA

SEQ ID NO: 11313 - protein, 9 aa, Homo sapiens
LMAGCIQEA

SEQ ID NO: 11314 - protein, 9 aa, Homo sapiens
LMKDCEAEV

SEQ ID NO: 11315 - protein, 9 aa, Homo sapiens
LMNNHQLEL

SEQ ID NO: 11316 - protein, 9 aa, Homo sapiens
LQLEAIHKV

SEQ ID NO: 11317 - protein, 9 aa, Homo sapiens
LQPEHPREV

SEQ ID NO: 11318 - protein, 9 aa, Homo sapiens
MAPERVASL

SEQ ID NO: 11319 - protein, 9 aa, Homo sapiens
NILSEVTAV

SEQ ID NO: 11320 - protein, 9 aa, Homo sapiens
NLQEGEFLL

SEQ ID NO: 11321 - protein, 9 aa, Homo sapiens
NLTDICTQL

SEQ ID NO: 11322 - protein, 10 aa, Homo sapiens
PLCIGRLIPV

SEQ ID NO: 11323 - protein, 9 aa, Homo sapiens
QILEAIPQV

SEQ ID NO: 11324 - protein, 9 aa, Homo sapiens
QILEGVYYL

SEQ ID NO: 11325 - protein, 9 aa, Homo sapiens
QIMEDLRTL

SEQ ID NO: 11326 - protein, 9 aa, Homo sapiens
QLAPVFQRV

SEQ ID NO: 11327 - protein, 9 aa, Homo sapiens
QLFDQIPEL

SEQ ID NO: 11328 - protein, 9 aa, Homo sapiens
QLHGLQLRI

SEQ ID NO: 11329 - protein, 10 aa, Homo sapiens
QLLDCDTPSV

SEQ ID NO: 11330 - protein, 9 aa, Homo sapiens
QLLEDSHQV

SEQ ID NO: 11331 - protein, 9 aa, Homo sapiens
QLPEGASAV

SEQ ID NO: 11332 - protein, 9 aa, Homo sapiens
QLPELFHKI

SEQ ID NO: 11333 - protein, 9 aa, Homo sapiens
QLPSGWASI

SEQ ID NO: 11334 - protein, 11 aa, Homo sapiens
QLQPTDALLCV

SEQ ID NO: 11335 - protein, 9 aa, Homo sapiens
QLSDVAEKL

SEQ ID NO: 11336 - protein, 10 aa, Homo sapiens
QQSCGTYLRV

SEQ ID NO: 11337 - protein, 9 aa, Homo sapiens
RAFGIPIRV

SEQ ID NO: 11338 - protein, 9 aa, Homo sapiens
RALDHYLTL

SEQ ID NO: 11339 - protein, 9 aa, Homo sapiens
RIDGKTYVI

SEQ ID NO: 11340 - protein, 9 aa, Homo sapiens
RIFEKMFAM

SEQ ID NO: 11341 - protein, 8 aa, Homo sapiens
RIFKAWAV

SEQ ID NO: 11342 - protein, 9 aa, Homo sapiens
RIIDCAFTV

SEQ ID NO: 11343 - protein, 9 aa, Homo sapiens
RIIEAAHQV

SEQ ID NO: 11344 - protein, 10 aa, Homo sapiens
RILGGVISAI

SEQ ID NO: 11345 - protein, 9 aa, Homo sapiens
RISSKSLKV

SEQ ID NO: 11346 - protein, 9 aa, Homo sapiens
RIYESHVGI

SEQ ID NO: 11347 - protein, 10 aa, Homo sapiens
RLAAIVAKQV

SEQ ID NO: 11348 - protein, 11 aa, Homo sapiens
RLAAIVAKQVL

SEQ ID NO: 11349 - protein, 9 aa, Homo sapiens
RLAECVKQV

SEQ ID NO: 11350 - protein, 9 aa, Homo sapiens
RLAHLGVQV

SEQ ID NO: 11351 - protein, 9 aa, Homo sapiens
RLALFNPDV

SEQ ID NO: 11352 - protein, 9 aa, Homo sapiens
RLAPLIQVI

SEQ ID NO: 11353 - protein, 9 aa, Homo sapiens
RLAQICSSI

SEQ ID NO: 11354 - protein, 11 aa, Homo sapiens
RLFPVPGSGLV

SEQ ID NO: 11355 - protein, 9 aa, Homo sapiens
RLGDKILQV

SEQ ID NO: 11356 - protein, 8 aa, Homo sapiens
RLGDVVRV

SEQ ID NO: 11357 - protein, 8 aa, Homo sapiens
RLGFTPSV

SEQ ID NO: 11358 - protein, 8 aa, Homo sapiens
RLGHAPCV

SEQ ID NO: 11359 - protein, 9 aa, Homo sapiens
RLGPVPPGL

SEQ ID NO: 11360 - protein, 10 aa, Homo sapiens
RLINLVGESL

SEQ ID NO: 11361 - protein, 9 aa, Homo sapiens
RLKEAFDYI

SEQ ID NO: 11362 - protein, 9 aa, Homo sapiens
RLLEQGIRV

SEQ ID NO: 11363 - protein, 11 aa, Homo sapiens
RLLNVEVPQKV

SEQ ID NO: 11364 - protein, 9 aa, Homo sapiens
RLLQQVSQI

SEQ ID NO: 11365 - protein, 11 aa, Homo sapiens
RLMANPEALKI

SEQ ID NO: 11366 - protein, 8 aa, Homo sapiens
RLNDSPTL

SEQ ID NO: 11367 - protein, 9 aa, Homo sapiens
RLNIPVSQV

SEQ ID NO: 11368 - protein, 9 aa, Homo sapiens
RLNKKVVLL

SEQ ID NO: 11369 - protein, 9 aa, Homo sapiens
RLNPEMLQI

SEQ ID NO: 11370 - protein, 9 aa, Homo sapiens
RLNPKALTL

SEQ ID NO: 11371 - protein, 10 aa, Homo sapiens
RLPEHCIEYV

SEQ ID NO: 11372 - protein, 9 aa, Homo sapiens
RLPPEVNRI

SEQ ID NO: 11373 - protein, 9 aa, Homo sapiens
RLPRSVTTV

SEQ ID NO: 11374 - protein, 9 aa, Homo sapiens
RLQEASQTI

SEQ ID NO: 11375 - protein, 9 aa, Homo sapiens
RLQKLHTSI

SEQ ID NO: 11376 - protein, 9 aa, Homo sapiens
RLQTALLVV

SEQ ID NO: 11377 - protein, 9 aa, Homo sapiens
RLRSFTTTI

SEQ ID NO: 11378 - protein, 9 aa, Homo sapiens
RLTDLCTKI

SEQ ID NO: 11379 - protein, 9 aa, Homo sapiens
RLTDTDAAI

SEQ ID NO: 11380 - protein, 9 aa, Homo sapiens
RLTEICTKI

SEQ ID NO: 11381 - protein, 9 aa, Homo sapiens
RLVEGLREA

SEQ ID NO: 11382 - protein, 9 aa, Homo sapiens
RLVQHDLQV

SEQ ID NO: 11383 - protein, 9 aa, Homo sapiens
RLYGLGTGV

SEQ ID NO: 11384 - protein, 9 aa, Homo sapiens
RLYKDDQLL

SEQ ID NO: 11385 - protein, 9 aa, Homo sapiens
RLYTGMHTV

SEQ ID NO: 11386 - protein, 9 aa, Homo sapiens
RMIGQICEV

SEQ ID NO: 11387 - protein, 9 aa, Homo sapiens
RQADFVQVL

SEQ ID NO: 11388 - protein, 10 aa, Homo sapiens
RQAEITRLLL

SEQ ID NO: 11389 - protein, 9 aa, Homo sapiens
RQDRLTVGV

SEQ ID NO: 11390 - protein, 9 aa, Homo sapiens
RQLEAIVRI

SEQ ID NO: 11391 - protein, 9 aa, Homo sapiens
RQLEVLQSI

SEQ ID NO: 11392 - protein, 9 aa, Homo sapiens
RQLTEKLTV

SEQ ID NO: 11393 - protein, 10 aa, Homo sapiens
RQMDIIVSEV

SEQ ID NO: 11394 - protein, 9 aa, Homo sapiens
RQMEKDETV

SEQ ID NO: 11395 - protein, 9 aa, Homo sapiens
RQPYYATRV

SEQ ID NO: 11396 - protein, 9 aa, Homo sapiens
RQSDLLVKL

SEQ ID NO: 11397 - protein, 9 aa, Homo sapiens
RQTGKILKV

SEQ ID NO: 11398 - protein, 9 aa, Homo sapiens
RQTYFLPVI

SEQ ID NO: 11399 - protein, 9 aa, Homo sapiens
RQWDYTEKL

SEQ ID NO: 11400 - protein, 9 aa, Homo sapiens
RQWKKISAI

SEQ ID NO: 11401 - protein, 9 aa, Homo sapiens
RQWLAIQKL

SEQ ID NO: 11402 - protein, 9 aa, Homo sapiens
RQYTEAISV

SEQ ID NO: 11403 - protein, 9 aa, Homo sapiens
RTLDLPIYV

SEQ ID NO: 11404 - protein, 9 aa, Homo sapiens
RVLPNLPCV

SEQ ID NO: 11405 - protein, 9 aa, Homo sapiens
RVLQNLLTI

SEQ ID NO: 11406 - protein, 9 aa, Homo sapiens
RVMSGKLTV

SEQ ID NO: 11407 - protein, 9 aa, Homo sapiens
RVTECLTTV

SEQ ID NO: 11408 - protein, 9 aa, Homo sapiens
SAIHTIAHL

SEQ ID NO: 11409 - protein, 9 aa, Homo sapiens
SASKSVLEV

SEQ ID NO: 11410 - protein, 9 aa, Homo sapiens
SIAECLTYL

SEQ ID NO: 11411 - protein, 9 aa, Homo sapiens
SIARVLTVI

SEQ ID NO: 11412 - protein, 10 aa, Homo sapiens
SLAECGAQGV

SEQ ID NO: 11413 - protein, 9 aa, Homo sapiens
SLAEVQCHL

SEQ ID NO: 11414 - protein, 9 aa, Homo sapiens
SLAPVLCGI

SEQ ID NO: 11415 - protein, 9 aa, Homo sapiens
SLDEAQFVL

SEQ ID NO: 11416 - protein, 9 aa, Homo sapiens
SLDGHLQAV

SEQ ID NO: 11417 - protein, 9 aa, Homo sapiens
SLDGRQIRV

SEQ ID NO: 11418 - protein, 9 aa, Homo sapiens
SLFDAVSSL

SEQ ID NO: 11419 - protein, 10 aa, Homo sapiens
SLGPPGPPGL

SEQ ID NO: 11420 - protein, 9 aa, Homo sapiens
SLHGTVMKI

SEQ ID NO: 11421 - protein, 9 aa, Homo sapiens
SLIRLVPKL

SEQ ID NO: 11422 - protein, 11 aa, Homo sapiens
SLLPADCQIHL

SEQ ID NO: 11423 - protein, 9 aa, Homo sapiens
SLLPVMQHL

SEQ ID NO: 11424 - protein, 9 aa, Homo sapiens
SLQEYIVSA

SEQ ID NO: 11425 - protein, 9 aa, Homo sapiens
SLSEYDQCL

SEQ ID NO: 11426 - protein, 9 aa, Homo sapiens
SLSGRPLKV

SEQ ID NO: 11427 - protein, 9 aa, Homo sapiens
SLSRVMIHV

SEQ ID NO: 11428 - protein, 9 aa, Homo sapiens
SLTDKVQEA

SEQ ID NO: 11429 - protein, 9 aa, Homo sapiens
SLTNTDLKV

SEQ ID NO: 11430 - protein, 9 aa, Homo sapiens
SLYVQQLKI

SEQ ID NO: 11431 - protein, 10 aa, Homo sapiens
SMIDCSMVQV

SEQ ID NO: 11432 - protein, 9 aa, Homo sapiens
SMPEQAHKV

SEQ ID NO: 11433 - protein, 9 aa, Homo sapiens
SQADCAVLI

SEQ ID NO: 11434 - protein, 9 aa, Homo sapiens
SQFGHVVDI

SEQ ID NO: 11435 - protein, 8 aa, Homo sapiens
SQFLYPKV

SEQ ID NO: 11436 - protein, 9 aa, Homo sapiens
SQFPGTQRL

SEQ ID NO: 11437 - protein, 9 aa, Homo sapiens
SQHDILQMI

SEQ ID NO: 11438 - protein, 9 aa, Homo sapiens
SQIKYAAKV

SEQ ID NO: 11439 - protein, 9 aa, Homo sapiens
SQIYPVVCV

SEQ ID NO: 11440 - protein, 9 aa, Homo sapiens
SQLDVPFKV

SEQ ID NO: 11441 - protein, 8 aa, Homo sapiens
SQLKLWNV

SEQ ID NO: 11442 - protein, 9 aa, Homo sapiens
SQPSKTLFV

SEQ ID NO: 11443 - protein, 9 aa, Homo sapiens
SQSNMTQKV

SEQ ID NO: 11444 - protein, 9 aa, Homo sapiens
SQTDGTLKI

SEQ ID NO: 11445 - protein, 9 aa, Homo sapiens
SQVTFPIRV

SEQ ID NO: 11446 - protein, 9 aa, Homo sapiens
SQWSLQHEI

SEQ ID NO: 11447 - protein, 9 aa, Homo sapiens
SSTSHVPEV

SEQ ID NO: 11448 - protein, 9 aa, Homo sapiens
SVALVIHNV

SEQ ID NO: 11449 - protein, 11 aa, Homo sapiens
SVFPGARLLTI

SEQ ID NO: 11450 - protein, 9 aa, Homo sapiens
SVISHLLRV

SEQ ID NO: 11451 - protein, 9 aa, Homo sapiens
SVTDLAFKV

SEQ ID NO: 11452 - protein, 9 aa, Homo sapiens
SVWFGPKEV

SEQ ID NO: 11453 - protein, 9 aa, Homo sapiens
TIAGVPQSV

SEQ ID NO: 11454 - protein, 9 aa, Homo sapiens
TIANVPILI

SEQ ID NO: 11455 - protein, 9 aa, Homo sapiens
TIFGKAHSL

SEQ ID NO: 11456 - protein, 9 aa, Homo sapiens
TILDKAMVL

SEQ ID NO: 11457 - protein, 9 aa, Homo sapiens
TISAYYARV

SEQ ID NO: 11458 - protein, 9 aa, Homo sapiens
TLAPATSIL

SEQ ID NO: 11459 - protein, 9 aa, Homo sapiens
TLENGVPCV

SEQ ID NO: 11460 - protein, 9 aa, Homo sapiens
TLFPKDVQL

SEQ ID NO: 11461 - protein, 9 aa, Homo sapiens
TLHAAVLQI

SEQ ID NO: 11462 - protein, 9 aa, Homo sapiens
TLICDVHSI

SEQ ID NO: 11463 - protein, 9 aa, Homo sapiens
TLLDRNTEL

SEQ ID NO: 11464 - protein, 9 aa, Homo sapiens
TLLEALDCI

SEQ ID NO: 11465 - protein, 9 aa, Homo sapiens
TLLSCKVQL

SEQ ID NO: 11466 - protein, 9 aa, Homo sapiens
TLLSNSISV

SEQ ID NO: 11467 - protein, 9 aa, Homo sapiens
TLMSLPTKI

SEQ ID NO: 11468 - protein, 10 aa, Homo sapiens
TLPKISPSSL

SEQ ID NO: 11469 - protein, 9 aa, Homo sapiens
TLPYIKQEV

SEQ ID NO: 11470 - protein, 9 aa, Homo sapiens
TLQNTVDIL

SEQ ID NO: 11471 - protein, 9 aa, Homo sapiens
TLSSIRHMI

SEQ ID NO: 11472 - protein, 9 aa, Homo sapiens
TLTDCVVVV

SEQ ID NO: 11473 - protein, 9 aa, Homo sapiens
TLWVDPCEV

SEQ ID NO: 11474 - protein, 9 aa, Homo sapiens
TQAGIVAHI

SEQ ID NO: 11475 - protein, 9 aa, Homo sapiens
TQLDVPHVI

SEQ ID NO: 11476 - protein, 9 aa, Homo sapiens
TQPPSHFSV

SEQ ID NO: 11477 - protein, 9 aa, Homo sapiens
TQPTHSWKV

SEQ ID NO: 11478 - protein, 9 aa, Homo sapiens
TTNGGILTV

SEQ ID NO: 11479 - protein, 9 aa, Homo sapiens
TVLATVQAL

SEQ ID NO: 11480 - protein, 9 aa, Homo sapiens
TVNEIVLKV

SEQ ID NO: 11481 - protein, 10 aa, Homo sapiens
VIACDGIWNV

SEQ ID NO: 11482 - protein, 9 aa, Homo sapiens
VIHATVTSV

SEQ ID NO: 11483 - protein, 9 aa, Homo sapiens
VILDPVHSV

SEQ ID NO: 11484 - protein, 9 aa, Homo sapiens
VILRDSHGV

SEQ ID NO: 11485 - protein, 9 aa, Homo sapiens
VLADACWAL

SEQ ID NO: 11486 - protein, 9 aa, Homo sapiens
VLADFEAGL

SEQ ID NO: 11487 - protein, 10 aa, Homo sapiens
VLADQGVCCI

SEQ ID NO: 11488 - protein, 10 aa, Homo sapiens
VLADRGVCLI

SEQ ID NO: 11489 - protein, 9 aa, Homo sapiens
VLAEIPQQV

SEQ ID NO: 11490 - protein, 9 aa, Homo sapiens
VLAPHLTRA

SEQ ID NO: 11491 - protein, 9 aa, Homo sapiens
VLESTMVCV

SEQ ID NO: 11492 - protein, 9 aa, Homo sapiens
VLIKDTTAL

SEQ ID NO: 11493 - protein, 10 aa, Homo sapiens
VLLDVCPLTL

SEQ ID NO: 11494 - protein, 10 aa, Homo sapiens
VLLHEVPHEV

SEQ ID NO: 11495 - protein, 12 aa, Homo sapiens
VLLPKKTESHKA

SEQ ID NO: 11496 - protein, 9 aa, Homo sapiens
VLLTHCHSL

SEQ ID NO: 11497 - protein, 9 aa, Homo sapiens
VLMGHVAAV

SEQ ID NO: 11498 - protein, 11 aa, Homo sapiens
VLPDSGHLHPL

SEQ ID NO: 11499 - protein, 9 aa, Homo sapiens
VLPERYSSL

SEQ ID NO: 11500 - protein, 9 aa, Homo sapiens
VLPPPPTTL

SEQ ID NO: 11501 - protein, 9 aa, Homo sapiens
VLPRDTASL

SEQ ID NO: 11502 - protein, 9 aa, Homo sapiens
VLPVPPLSV

SEQ ID NO: 11503 - protein, 9 aa, Homo sapiens
VLPVYMNCL

SEQ ID NO: 11504 - protein, 9 aa, Homo sapiens
VLQPYEHLI

SEQ ID NO: 11505 - protein, 9 aa, Homo sapiens
VLSECSPLM

SEQ ID NO: 11506 - protein, 10 aa, Homo sapiens
VLSSLPLNSL

SEQ ID NO: 11507 - protein, 10 aa, Homo sapiens
VLTDLPCVGV

SEQ ID NO: 11508 - protein, 9 aa, Homo sapiens
VLYPGCDTL

SEQ ID NO: 11509 - protein, 9 aa, Homo sapiens
VQAPVIQQV

SEQ ID NO: 11510 - protein, 10 aa, Homo sapiens
VQIKDVNLEV

SEQ ID NO: 11511 - protein, 9 aa, Homo sapiens
VQPLELPMV

SEQ ID NO: 11512 - protein, 9 aa, Homo sapiens
VVDGHKLEV

SEQ ID NO: 11513 - protein, 9 aa, Homo sapiens
VVSGVVSKV

SEQ ID NO: 11514 - protein, 9 aa, Homo sapiens
WLLEQTSHV

SEQ ID NO: 11515 - protein, 9 aa, Homo sapiens
WLLQKNPQL

SEQ ID NO: 11516 - protein, 9 aa, Homo sapiens
WLSTSIPEA

SEQ ID NO: 11517 - protein, 9 aa, Homo sapiens
YAIGNAPEL

SEQ ID NO: 11518 - protein, 9 aa, Homo sapiens
YIASLPFQV

SEQ ID NO: 11519 - protein, 9 aa, Homo sapiens
YIFTTPKSV

SEQ ID NO: 11520 - protein, 9 aa, Homo sapiens
YIVPCLHEV

SEQ ID NO: 11521 - protein, 9 aa, Homo sapiens
YLDRYLSCV

SEQ ID NO: 11522 - protein, 9 aa, Homo sapiens
YLFKCPQSV

SEQ ID NO: 11523 - protein, 9 aa, Homo sapiens
YLFPGHPPT

SEQ ID NO: 11524 - protein, 9 aa, Homo sapiens
YLHDQNPDA

SEQ ID NO: 11525 - protein, 9 aa, Homo sapiens
YLLDGSCMV

SEQ ID NO: 11526 - protein, 11 aa, Homo sapiens
YLLDIGCGTGL

SEQ ID NO: 11527 - protein, 9 aa, Homo sapiens
YLLHGLECV

SEQ ID NO: 11528 - protein, 9 aa, Homo sapiens
YLLQYATLL

SEQ ID NO: 11529 - protein, 10 aa, Homo sapiens
YLLVRRVLHL

SEQ ID NO: 11530 - protein, 9 aa, Homo sapiens
YLPDKLPKV

SEQ ID NO: 11531 - protein, 9 aa, Homo sapiens
YLPPGVIAL

SEQ ID NO: 11532 - protein, 9 aa, Homo sapiens
YLQCKLEQL

SEQ ID NO: 11533 - protein, 9 aa, Homo sapiens
YLQSEPCYV

SEQ ID NO: 11534 - protein, 9 aa, Homo sapiens
YLQSITPCL

SEQ ID NO: 11535 - protein, 9 aa, Homo sapiens
YLSDFICCL

SEQ ID NO: 11536 - protein, 11 aa, Homo sapiens
YLSDPCPGLYL

SEQ ID NO: 11537 - protein, 9 aa, Homo sapiens
YLSTCIDQV

SEQ ID NO: 11538 - protein, 9 aa, Homo sapiens
YLYCGQEGL

SEQ ID NO: 11539 - protein, 10 aa, Homo sapiens
YMLPDGTYCL

SEQ ID NO: 11540 - protein, 9 aa, Homo sapiens
YQHAIEESV

SEQ ID NO: 11541 - protein, 8 aa, Homo sapiens
YQIAVTKV

SEQ ID NO: 11542 - protein, 9 aa, Homo sapiens
YQPQAIFRV

SEQ ID NO: 11543 - protein, 9 aa, Homo sapiens
YQTPLELKL

SEQ ID NO: 11544 - protein, 9 aa, Homo sapiens
YTFDPVTKV

SEQ ID NO: 11545 - protein, 9 aa, Homo sapiens
YTSNHIWKL

SEQ ID NO: 11546 - protein, 9 aa, Homo sapiens
YVDESRECV

SEQ ID NO: 11547 - protein, 9 aa, Homo sapiens
YVLEHNLHL

SEQ ID NO: 11548 - protein, 9 aa, Homo sapiens
YVMDTRPKL

SEQ ID NO: 11549 - protein, 11 aa, Hepatitis E virus
LRSLFWNEPAI

SEQ ID NO: 11550 - protein, 11 aa, Hepatitis E virus
YVSDTVTFVNV

SEQ ID NO: 11551 - protein, 9 aa, JC polyomavirus
SLMNVHSNG

SEQ ID NO: 11552 - protein, 9 aa, JC polyomavirus
VKNPYPISF

SEQ ID NO: 11553 - protein, 8 aa, Homo sapiens
ALAAALVV

SEQ ID NO: 11554 - protein, 8 aa, Homo sapiens
ALAAFLGL

SEQ ID NO: 11555 - protein, 11 aa, Homo sapiens
ALAALPSGDRV

SEQ ID NO: 11556 - protein, 8 aa, Homo sapiens
ALAGLSPV

SEQ ID NO: 11557 - protein, 8 aa, Homo sapiens
ALIGGPPV

SEQ ID NO: 11558 - protein, 8 aa, Homo sapiens
ALISKNPV

SEQ ID NO: 11559 - protein, 8 aa, Homo sapiens
ALLGIPKV

SEQ ID NO: 11560 - protein, 8 aa, Homo sapiens
ALVSIIKV

SEQ ID NO: 11561 - protein, 11 aa, Homo sapiens
AVAALPSGDRV

SEQ ID NO: 11562 - protein, 8 aa, Homo sapiens
GLGPVAAV

SEQ ID NO: 11563 - protein, 8 aa, Homo sapiens
GLLAIVKV

SEQ ID NO: 11564 - protein, 11 aa, Homo sapiens
IHDLLELKGPL

SEQ ID NO: 11565 - protein, 11 aa, Homo sapiens
IHDLLEPKGPL

SEQ ID NO: 11566 - protein, 9 aa, Homo sapiens
LLAAVAALL

SEQ ID NO: 11567 - protein, 8 aa, Homo sapiens
LLAGPPGV

SEQ ID NO: 11568 - protein, 11 aa, Homo sapiens
LLFPYILPPKA

SEQ ID NO: 11569 - protein, 10 aa, Homo sapiens
LLGCPVPLGV

SEQ ID NO: 11570 - protein, 8 aa, Homo sapiens
LLGPAPGV

SEQ ID NO: 11571 - protein, 11 aa, Homo sapiens
LLLELAGVTHV

SEQ ID NO: 11572 - protein, 9 aa, Homo sapiens
LLLPALAGA

SEQ ID NO: 11573 - protein, 9 aa, Homo sapiens
LLLRSPAGV

SEQ ID NO: 11574 - protein, 9 aa, Homo sapiens
LLSAVLPSV

SEQ ID NO: 11575 - protein, 11 aa, Homo sapiens
LLWRKLLWHQV

SEQ ID NO: 11576 - protein, 10 aa, Homo sapiens
SLLGLALLAV

SEQ ID NO: 11577 - protein, 9 aa, Human papillomavirus type 16
KISEYRHYV

SEQ ID NO: 11578 - protein, 10 aa, Hepatitis C virus
KLKSLGLNAV

SEQ ID NO: 11579 - protein, 9 aa, Human papillomavirus type 16
KLPQLCTEV

SEQ ID NO: 11580 - protein, 10 aa, Hepatitis C virus
QLRSLGLNAV

SEQ ID NO: 11581 - protein, 10 aa, Hepatitis C virus
QLRTLGLNAV

SEQ ID NO: 11582 - protein, 10 aa, Hepatitis C virus
QLSSLGLNAV

SEQ ID NO: 11583 - protein, 10 aa, Hepatitis C virus
QLTSLGLNAV

SEQ ID NO: 11584 - protein, 10 aa, Human papillomavirus type 16
QLYNKPLCDV

SEQ ID NO: 11585 - protein, 10 aa, Human papillomavirus type 16
QQYNKPLCDL

SEQ ID NO: 11586 - protein, 10 aa, Human papillomavirus type 16
RTLEDLLMGV

SEQ ID NO: 11587 - protein, 9 aa, Human papillomavirus type 16
TLHEYMLDV

SEQ ID NO: 11588 - protein, 9 aa, Human papillomavirus type 16
YMLDLQPEV

SEQ ID NO: 11589 - protein, 9 aa, Yellow fever virus 17D
GMVAPLYGV

SEQ ID NO: 11590 - protein, 11 aa, Homo sapiens
  misc_feature (10)..(10): Xaa can be any naturally occurring amino acid
MLYQHLLPLXM

SEQ ID NO: 11591 - protein, 8 aa, Homo sapiens
LIGEVFVL

SEQ ID NO: 11592 - protein, 8 aa, Homo sapiens
LLGEVFEL

SEQ ID NO: 11593 - protein, 8 aa, Homo sapiens
LPGEVFAI

SEQ ID NO: 11594 - protein, 8 aa, Homo sapiens
LVGEVWGL

SEQ ID NO: 11595 - protein, 8 aa, Homo sapiens
MEGEVWGL

SEQ ID NO: 11596 - protein, 9 aa, Homo sapiens
MLGGEVFYV

SEQ ID NO: 11597 - protein, 9 aa, Homo sapiens
MLIGEVFNI

SEQ ID NO: 11598 - protein, 9 aa, Homo sapiens
MLPGEVFAI

SEQ ID NO: 11599 - protein, 9 aa, Homo sapiens
AMFWSVPTV

SEQ ID NO: 11600 - protein, 10 aa, Homo sapiens
ASLGPTIEEV

SEQ ID NO: 11601 - protein, 9 aa, Homo sapiens
CLNEYHLFL

SEQ ID NO: 11602 - protein, 10 aa, Homo sapiens
EIFDGNVAHI

SEQ ID NO: 11603 - protein, 9 aa, Homo sapiens
EIIHEIAVL

SEQ ID NO: 11604 - protein, 9 aa, Homo sapiens
EVIALLHSL

SEQ ID NO: 11605 - protein, 9 aa, Homo sapiens
EVIRELAGI

SEQ ID NO: 11606 - protein, 9 aa, Homo sapiens
FLAPVKTEV

SEQ ID NO: 11607 - protein, 9 aa, Homo sapiens
FLYNLLTRV

SEQ ID NO: 11608 - protein, 9 aa, Homo sapiens
HLYASLSRV

SEQ ID NO: 11609 - protein, 9 aa, Homo sapiens
IILVAVPHV

SEQ ID NO: 11610 - protein, 9 aa, Homo sapiens
KLMNIQQKL

SEQ ID NO: 11611 - protein, 10 aa, Homo sapiens
KMAGIGIREA

SEQ ID NO: 11612 - protein, 9 aa, Homo sapiens
KMIGNHLWV

SEQ ID NO: 11613 - protein, 9 aa, Homo sapiens
KTLLVSEEL

SEQ ID NO: 11614 - protein, 9 aa, Homo sapiens
LDINALQEL

SEQ ID NO: 11615 - protein, 9 aa, Homo sapiens
LVDKLQLKV

SEQ ID NO: 11616 - protein, 9 aa, Homo sapiens
MLGEQLFPL

SEQ ID NO: 11617 - protein, 9 aa, Homo sapiens
QIDPTIQRV

SEQ ID NO: 11618 - protein, 9 aa, Homo sapiens
QLSCISTYV

SEQ ID NO: 11619 - protein, 9 aa, Homo sapiens
RLLPLPLGV

SEQ ID NO: 11620 - protein, 8 aa, Homo sapiens
RLQTALLV

SEQ ID NO: 11621 - protein, 9 aa, Homo sapiens
RVIDYAVKI

SEQ ID NO: 11622 - protein, 9 aa, Homo sapiens
RVVELQQTL

SEQ ID NO: 11623 - protein, 9 aa, Homo sapiens
TTRPALKEL

SEQ ID NO: 11624 - protein, 9 aa, Homo sapiens
TVYPMERLV

SEQ ID NO: 11625 - protein, 9 aa, Homo sapiens
YLPKIQLVI

SEQ ID NO: 11626 - protein, 9 aa, Leishmania donovani
FLQLLLVTL

SEQ ID NO: 11627 - protein, 9 aa, Leishmania donovani
FMGDIHQPL

SEQ ID NO: 11628 - protein, 9 aa, Leishmania donovani
LEATYASTL

SEQ ID NO: 11629 - protein, 9 aa, Leishmania donovani
LLSTAALPV

SEQ ID NO: 11630 - protein, 9 aa, Leishmania donovani
REANLSHYV

SEQ ID NO: 11631 - protein, 10 aa, Homo sapiens
KLAGIGILTV

SEQ ID NO: 11632 - protein, 9 aa, Homo sapiens
RIADLSYTV

SEQ ID NO: 11633 - protein, 9 aa, Homo sapiens
RILDYVINL

SEQ ID NO: 11634 - protein, 9 aa, Homo sapiens
SLASVFVRL

SEQ ID NO: 11635 - protein, 9 aa, Homo sapiens
TLLGKEIKI

SEQ ID NO: 11636 - protein, 9 aa, Homo sapiens
AIFSAIIFL

SEQ ID NO: 11637 - protein, 9 aa, Homo sapiens
AIWDGLILL

SEQ ID NO: 11638 - protein, 9 aa, Homo sapiens
ALADTLVLL

SEQ ID NO: 11639 - protein, 9 aa, Homo sapiens
ALAHNLLVK

SEQ ID NO: 11640 - protein, 9 aa, Homo sapiens
ALAWLDVTL

SEQ ID NO: 11641 - protein, 10 aa, Homo sapiens
ALDAGAVYTL

SEQ ID NO: 11642 - protein, 9 aa, Homo sapiens
ALDKLNEAI

SEQ ID NO: 11643 - protein, 9 aa, Homo sapiens
ALFETLIQL

SEQ ID NO: 11644 - protein, 11 aa, Homo sapiens
  misc_feature (10)..(10): Xaa can be any naturally occurring amino acid
ALFGIPMALXM

SEQ ID NO: 11645 - protein, 9 aa, Homo sapiens
ALFSFLYHL

SEQ ID NO: 11646 - protein, 9 aa, Homo sapiens
ALLADEFAL

SEQ ID NO: 11647 - protein, 9 aa, Homo sapiens
ALLAKILQI

SEQ ID NO: 11648 - protein, 9 aa, Homo sapiens
ALLALLPEL

SEQ ID NO: 11649 - protein, 9 aa, Homo sapiens
ALLDFLWDL

SEQ ID NO: 11650 - protein, 12 aa, Homo sapiens
ALLDPEVLSIFV

SEQ ID NO: 11651 - protein, 11 aa, Homo sapiens
ALLDVSNNYGI

SEQ ID NO: 11652 - protein, 9 aa, Homo sapiens
ALLEGLTVV

SEQ ID NO: 11653 - protein, 9 aa, Homo sapiens
ALLEGVKNV

SEQ ID NO: 11654 - protein, 9 aa, Homo sapiens
ALLPGNFTV

SEQ ID NO: 11655 - protein, 9 aa, Homo sapiens
ALLPVDIFL

SEQ ID NO: 11656 - protein, 9 aa, Homo sapiens
ALLRLLPGL

SEQ ID NO: 11657 - protein, 10 aa, Homo sapiens
ALLSLHFLFV

SEQ ID NO: 11658 - protein, 9 aa, Homo sapiens
ALMDFAYTA

SEQ ID NO: 11659 - protein, 11 aa, Homo sapiens
ALPEVLAVIQV

SEQ ID NO: 11660 - protein, 9 aa, Homo sapiens
ALQALVVTL

SEQ ID NO: 11661 - protein, 9 aa, Homo sapiens
ALQDFLLSV

SEQ ID NO: 11662 - protein, 11 aa, Homo sapiens
ALQEAIDAIFL

SEQ ID NO: 11663 - protein, 9 aa, Homo sapiens
ALQESIPDI

SEQ ID NO: 11664 - protein, 10 aa, Homo sapiens
ALQPGTLQLI

SEQ ID NO: 11665 - protein, 9 aa, Homo sapiens
ALQTIQLFL

SEQ ID NO: 11666 - protein, 9 aa, Homo sapiens
ALQTKLETL

SEQ ID NO: 11667 - protein, 9 aa, Homo sapiens
ALSDYDLVL

SEQ ID NO: 11668 - protein, 17 aa, Homo sapiens
ALSEAMGLFCLCYSTLC

SEQ ID NO: 11669 - protein, 9 aa, Homo sapiens
ALSSLLVFL

SEQ ID NO: 11670 - protein, 15 aa, Homo sapiens
ALTDVILCVCYSTLC

SEQ ID NO: 11671 - protein, 9 aa, Homo sapiens
ALTWLIPTL

SEQ ID NO: 11672 - protein, 9 aa, Homo sapiens
ALVHITLIL

SEQ ID NO: 11673 - protein, 10 aa, Homo sapiens
ALVQITLPTV

SEQ ID NO: 11674 - protein, 10 aa, Homo sapiens
ALWVSQPPEI

SEQ ID NO: 11675 - protein, 9 aa, Homo sapiens
ALYAVIEKA

SEQ ID NO: 11676 - protein, 10 aa, Homo sapiens
ALYEYQPLQI

SEQ ID NO: 11677 - protein, 10 aa, Homo sapiens
ALYTGFSILV

SEQ ID NO: 11678 - protein, 10 aa, Homo sapiens
APGNLSLPIP

SEQ ID NO: 11679 - protein, 9 aa, Homo sapiens
AQILELPYA

SEQ ID NO: 11680 - protein, 9 aa, Homo sapiens
AVLGFSFRL

SEQ ID NO: 11681 - protein, 10 aa, Homo sapiens
AVLQQHHVKL

SEQ ID NO: 11682 - protein, 11 aa, Homo sapiens
AVMAPRTLVLL

SEQ ID NO: 11683 - protein, 12 aa, Homo sapiens
AVVEPYNSILTT

SEQ ID NO: 11684 - protein, 17 aa, Homo sapiens
CLIKEVDIYTVCYSTLC

SEQ ID NO: 11685 - protein, 15 aa, Homo sapiens
CLYEIYPELCYSTLC

SEQ ID NO: 11686 - protein, 17 aa, Homo sapiens
CLYELPENIRVCYSTLC

SEQ ID NO: 11687 - protein, 17 aa, Homo sapiens
CLYPHIDKQYLCYSTLC

SEQ ID NO: 11688 - protein, 9 aa, Homo sapiens
EAVPYLEFI

SEQ ID NO: 11689 - protein, 9 aa, Homo sapiens
EIQYLKDLI

SEQ ID NO: 11690 - protein, 9 aa, Homo sapiens
FAMEIDPSL

SEQ ID NO: 11691 - protein, 9 aa, Homo sapiens
FIFDGLHKA

SEQ ID NO: 11692 - protein, 10 aa, Homo sapiens
FIYQGKIPIA

SEQ ID NO: 11693 - protein, 9 aa, Homo sapiens
FLASILEEL

SEQ ID NO: 11694 - protein, 9 aa, Homo sapiens
FLDIVELLL

SEQ ID NO: 11695 - protein, 10 aa, Homo sapiens
FLEGQIHPEL

SEQ ID NO: 11696 - protein, 9 aa, Homo sapiens
FLFQEVLVI

SEQ ID NO: 11697 - protein, 9 aa, Homo sapiens
FLFQFIPYM

SEQ ID NO: 11698 - protein, 8 aa, Homo sapiens
FLFRITQV

SEQ ID NO: 11699 - protein, 9 aa, Homo sapiens
FLFVDPELV

SEQ ID NO: 11700 - protein, 11 aa, Homo sapiens
FLFVDPELVSA

SEQ ID NO: 11701 - protein, 17 aa, Homo sapiens
FLGCIGAVNEVCYSTLC

SEQ ID NO: 11702 - protein, 10 aa, Homo sapiens
FLGEKYIRRV

SEQ ID NO: 11703 - protein, 9 aa, Homo sapiens
FLGIHVFLV

SEQ ID NO: 11704 - protein, 9 aa, Homo sapiens
FLHAADVVL

SEQ ID NO: 11705 - protein, 9 aa, Homo sapiens
FLHAVDVVL

SEQ ID NO: 11706 - protein, 9 aa, Homo sapiens
FLHESLILL

SEQ ID NO: 11707 - protein, 9 aa, Homo sapiens
FLIAALDVL

SEQ ID NO: 11708 - protein, 10 aa, Homo sapiens
FLIGILLREV

SEQ ID NO: 11709 - protein, 9 aa, Homo sapiens
FLIPKFFEL

SEQ ID NO: 11710 - protein, 9 aa, Homo sapiens
FLLALGHFL

SEQ ID NO: 11711 - protein, 12 aa, Homo sapiens
FLLDIEDRIYQG

SEQ ID NO: 11712 - protein, 10 aa, Homo sapiens
FLLEDDIHVS

SEQ ID NO: 11713 - protein, 9 aa, Homo sapiens
FLLEIRQTL

SEQ ID NO: 11714 - protein, 12 aa, Homo sapiens
FLLEPGNLEVLL

SEQ ID NO: 11715 - protein, 10 aa, Homo sapiens
FLLIQLSCYF

SEQ ID NO: 11716 - protein, 11 aa, Homo sapiens
FLLLPDAEAQL

SEQ ID NO: 11717 - protein, 11 aa, Homo sapiens
FLLPHPGLKVA

SEQ ID NO: 11718 - protein, 9 aa, Homo sapiens
FLLPLIIVL

SEQ ID NO: 11719 - protein, 10 aa, Homo sapiens
FLLQINDILL

SEQ ID NO: 11720 - protein, 9 aa, Homo sapiens
FLLQLHWRL

SEQ ID NO: 11721 - protein, 10 aa, Homo sapiens
FLLQQHLISA

SEQ ID NO: 11722 - protein, 9 aa, Homo sapiens
FLMWFIETA

SEQ ID NO: 11723 - protein, 9 aa, Homo sapiens
FLPQVVVTV

SEQ ID NO: 11724 - protein, 9 aa, Homo sapiens
FLSDIPETV

SEQ ID NO: 11725 - protein, 11 aa, Homo sapiens
FLSEVWNTHTL

SEQ ID NO: 11726 - protein, 10 aa, Homo sapiens
FLSPQQPPLL

SEQ ID NO: 11727 - protein, 9 aa, Homo sapiens
FLTAAIILL

SEQ ID NO: 11728 - protein, 10 aa, Homo sapiens
FLTEIENLFL

SEQ ID NO: 11729 - protein, 10 aa, Homo sapiens
FLVEEEDLFL

SEQ ID NO: 11730 - protein, 9 aa, Homo sapiens
FLVLDVVYL

SEQ ID NO: 11731 - protein, 10 aa, Homo sapiens
FLWTEKFPSL

SEQ ID NO: 11732 - protein, 10 aa, Homo sapiens
FLYAAQPELL

SEQ ID NO: 11733 - protein, 9 aa, Homo sapiens
FLYGGELVL

SEQ ID NO: 11734 - protein, 10 aa, Homo sapiens
FLYPFPLALF

SEQ ID NO: 11735 - protein, 9 aa, Homo sapiens
FLYWHLEDL

SEQ ID NO: 11736 - protein, 9 aa, Homo sapiens
FMFQEALKL

SEQ ID NO: 11737 - protein, 10 aa, Homo sapiens
FMYNFQLVTL

SEQ ID NO: 11738 - protein, 10 aa, Homo sapiens
FQWDSDNIYL

SEQ ID NO: 11739 - protein, 9 aa, Homo sapiens
FVDEFLTYL

SEQ ID NO: 11740 - protein, 11 aa, Homo sapiens
FVQPFGPQYEV

SEQ ID NO: 11741 - protein, 11 aa, Homo sapiens
GILSVRDATKI

SEQ ID NO: 11742 - protein, 9 aa, Homo sapiens
GLAAFRAFL

SEQ ID NO: 11743 - protein, 9 aa, Homo sapiens
GLAEILVLV

SEQ ID NO: 11744 - protein, 9 aa, Homo sapiens
GLAHFVNEI

SEQ ID NO: 11745 - protein, 9 aa, Homo sapiens
GLDDLLLFL

SEQ ID NO: 11746 - protein, 11 aa, Homo sapiens
GLDSNLKYILV

SEQ ID NO: 11747 - protein, 9 aa, Homo sapiens
GLFDQQLAL

SEQ ID NO: 11748 - protein, 11 aa, Homo sapiens
GLFERDKLIFL

SEQ ID NO: 11749 - protein, 15 aa, Homo sapiens
GLFGVPLCLCYSTLC

SEQ ID NO: 11750 - protein, 9 aa, Homo sapiens
GLFGYLVFL

SEQ ID NO: 11751 - protein, 11 aa, Homo sapiens
GLIEDHFDVTV

SEQ ID NO: 11752 - protein, 11 aa, Homo sapiens
GLISFSDYIFL

SEQ ID NO: 11753 - protein, 11 aa, Homo sapiens
GLLDGGVDILL

SEQ ID NO: 11754 - protein, 9 aa, Homo sapiens
GLLEEAYTL

SEQ ID NO: 11755 - protein, 9 aa, Homo sapiens
GLLEGLVEV

SEQ ID NO: 11756 - protein, 11 aa, Homo sapiens
GLLPEHFLFLA

SEQ ID NO: 11757 - protein, 16 aa, Homo sapiens
GLLPGCVYHVCYSTLC

SEQ ID NO: 11758 - protein, 11 aa, Homo sapiens
GLLPSKIRINL

SEQ ID NO: 11759 - protein, 10 aa, Homo sapiens
GLSPLRPPSV

SEQ ID NO: 11760 - protein, 11 aa, Homo sapiens
GLTLAPGLSPA

SEQ ID NO: 11761 - protein, 11 aa, Homo sapiens
GLVTWDAALYL

SEQ ID NO: 11762 - protein, 11 aa, Homo sapiens
GVAPSRAIYFA

SEQ ID NO: 11763 - protein, 9 aa, Homo sapiens
GVQDFVPFV

SEQ ID NO: 11764 - protein, 9 aa, Homo sapiens
GYFDERYVL

SEQ ID NO: 11765 - protein, 9 aa, Homo sapiens
HLLDIYIQL

SEQ ID NO: 11766 - protein, 10 aa, Homo sapiens
HLLPGDELYL

SEQ ID NO: 11767 - protein, 12 aa, Homo sapiens
HLLSELEAAPYL

SEQ ID NO: 11768 - protein, 11 aa, Homo sapiens
HLMEENMIVYV

SEQ ID NO: 11769 - protein, 8 aa, Homo sapiens
IFVEAVLR

SEQ ID NO: 11770 - protein, 9 aa, Homo sapiens
ILADIVISA

SEQ ID NO: 11771 - protein, 11 aa, Homo sapiens
ILADKSSFISV

SEQ ID NO: 11772 - protein, 9 aa, Homo sapiens
ILAQLLPLL

SEQ ID NO: 11773 - protein, 9 aa, Homo sapiens
ILASIFETV

SEQ ID NO: 11774 - protein, 15 aa, Homo sapiens
ILDCIYNEVCYSTLC

SEQ ID NO: 11775 - protein, 9 aa, Homo sapiens
ILFPLRFTL

SEQ ID NO: 11776 - protein, 9 aa, Homo sapiens
ILIETKLVL

SEQ ID NO: 11777 - protein, 11 aa, Homo sapiens
ILISVDGKVYL

SEQ ID NO: 11778 - protein, 9 aa, Homo sapiens
ILLLPLHTG

SEQ ID NO: 11779 - protein, 11 aa, Homo sapiens
ILLNIEHRIML

SEQ ID NO: 11780 - protein, 11 aa, Homo sapiens
ILLQENGHIYV

SEQ ID NO: 11781 - protein, 11 aa, Homo sapiens
ILSESANRIFL

SEQ ID NO: 11782 - protein, 9 aa, Homo sapiens
ILSVFIPSL

SEQ ID NO: 11783 - protein, 9 aa, Homo sapiens
ILSWVSFWI

SEQ ID NO: 11784 - protein, 9 aa, Homo sapiens
ILWDTLLRL

SEQ ID NO: 11785 - protein, 9 aa, Homo sapiens
ILWSEAIFL

SEQ ID NO: 11786 - protein, 10 aa, Homo sapiens
ILWSERPTKV

SEQ ID NO: 11787 - protein, 9 aa, Homo sapiens
IMEDIILTL

SEQ ID NO: 11788 - protein, 11 aa, Homo sapiens
ISERYGPVFTI

SEQ ID NO: 11789 - protein, 9 aa, Homo sapiens
IVMETVPVL

SEQ ID NO: 11790 - protein, 9 aa, Homo sapiens
KLAAVVNNL

SEQ ID NO: 11791 - protein, 11 aa, Homo sapiens
KLAPITYPQGL

SEQ ID NO: 11792 - protein, 11 aa, Homo sapiens
KLDTVSSKIEL

SEQ ID NO: 11793 - protein, 9 aa, Homo sapiens
KLDWHRFNL

SEQ ID NO: 11794 - protein, 17 aa, Homo sapiens
KLFADAGLVCICYSTLC

SEQ ID NO: 11795 - protein, 14 aa, Homo sapiens
KLFNVTSTLDEAMN

SEQ ID NO: 11796 - protein, 16 aa, Homo sapiens
KLFNVTSTLRIDEAMN

SEQ ID NO: 11797 - protein, 11 aa, Homo sapiens
KLFSTETSLQV

SEQ ID NO: 11798 - protein, 11 aa, Homo sapiens
KLFTQIFGVGV

SEQ ID NO: 11799 - protein, 9 aa, Homo sapiens
KLIDYIYTA

SEQ ID NO: 11800 - protein, 11 aa, Homo sapiens
KLITKAEKIRL

SEQ ID NO: 11801 - protein, 12 aa, Homo sapiens
KLLDFQEFTLYL

SEQ ID NO: 11802 - protein, 15 aa, Homo sapiens
KLLNITNPVLDEAMN

SEQ ID NO: 11803 - protein, 14 aa, Homo sapiens
KLLNNLTSIDEAMN

SEQ ID NO: 11804 - protein, 9 aa, Homo sapiens
KLLQLQEVF

SEQ ID NO: 11805 - protein, 10 aa, Homo sapiens
KLNLPDYYKI

SEQ ID NO: 11806 - protein, 9 aa, Homo sapiens
KLSFIIRTV

SEQ ID NO: 11807 - protein, 9 aa, Homo sapiens
KLTDNLVAL

SEQ ID NO: 11808 - protein, 10 aa, Homo sapiens
KLTDQTLIYL

SEQ ID NO: 11809 - protein, 11 aa, Homo sapiens
KLWNVAAPLYL

SEQ ID NO: 11810 - protein, 9 aa, Homo sapiens
KLWSFFIYL

SEQ ID NO: 11811 - protein, 9 aa, Homo sapiens
KMMELFIRL

SEQ ID NO: 11812 - protein, 9 aa, Homo sapiens
KTFNLIPAV

SEQ ID NO: 11813 - protein, 10 aa, Homo sapiens
KVGNFKFIYV

SEQ ID NO: 11814 - protein, 10 aa, Homo sapiens
KVGSFKFIYV

SEQ ID NO: 11815 - protein, 8 aa, Homo sapiens
KVLPQELV

SEQ ID NO: 11816 - protein, 9 aa, Homo sapiens
LAQLRVLYL

SEQ ID NO: 11817 - protein, 11 aa, Homo sapiens
LEGLLPRLLSL

SEQ ID NO: 11818 - protein, 9 aa, Homo sapiens
LFKNAERML

SEQ ID NO: 11819 - protein, 8 aa, Homo sapiens
LFNENPYP

SEQ ID NO: 11820 - protein, 9 aa, Homo sapiens
LIQYHEPEL

SEQ ID NO: 11821 - protein, 11 aa, Homo sapiens
LLAGFAFLTGV

SEQ ID NO: 11822 - protein, 9 aa, Homo sapiens
LLAHVTLEL

SEQ ID NO: 11823 - protein, 9 aa, Homo sapiens
LLAPIVFVL

SEQ ID NO: 11824 - protein, 11 aa, Homo sapiens
LLDEPTNHLDL

SEQ ID NO: 11825 - protein, 11 aa, Homo sapiens
LLFEHSDIVVI

SEQ ID NO: 11826 - protein, 11 aa, Homo sapiens
LLFGKIGYYLV

SEQ ID NO: 11827 - protein, 9 aa, Homo sapiens
LLFTWEELI

SEQ ID NO: 11828 - protein, 8 aa, Homo sapiens
LLGQVFQV

SEQ ID NO: 11829 - protein, 12 aa, Homo sapiens
LLIDTQGVPYTV

SEQ ID NO: 11830 - protein, 9 aa, Homo sapiens
LLIGTDVSL

SEQ ID NO: 11831 - protein, 11 aa, Homo sapiens
LLLDERQDVHL

SEQ ID NO: 11832 - protein, 9 aa, Homo sapiens
LLLDIMPGL

SEQ ID NO: 11833 - protein, 10 aa, Homo sapiens
LLLDTEGFVK

SEQ ID NO: 11834 - protein, 11 aa, Homo sapiens
LLLEPGSLYIL

SEQ ID NO: 11835 - protein, 9 aa, Homo sapiens
LLLNELPSV

SEQ ID NO: 11836 - protein, 11 aa, Homo sapiens
LLLPETQSLPL

SEQ ID NO: 11837 - protein, 11 aa, Homo sapiens
LLLTDQHLYKL

SEQ ID NO: 11838 - protein, 11 aa, Homo sapiens
LLLYEEGLRVV

SEQ ID NO: 11839 - protein, 9 aa, Homo sapiens
LLNKSIIRV

SEQ ID NO: 11840 - protein, 9 aa, Homo sapiens
LLPDEIADV

SEQ ID NO: 11841 - protein, 11 aa, Homo sapiens
LLPGVDVLLEV

SEQ ID NO: 11842 - protein, 9 aa, Homo sapiens
LLPIKTVGV

SEQ ID NO: 11843 - protein, 9 aa, Homo sapiens
LLPNAVYKV

SEQ ID NO: 11844 - protein, 9 aa, Homo sapiens
LLSEHVIAI

SEQ ID NO: 11845 - protein, 9 aa, Homo sapiens
LLSGFVPLL

SEQ ID NO: 11846 - protein, 9 aa, Homo sapiens
LLSGQLPTI

SEQ ID NO: 11847 - protein, 9 aa, Homo sapiens
LLSSIVEEL

SEQ ID NO: 11848 - protein, 9 aa, Homo sapiens
LLSSVSIAL

SEQ ID NO: 11849 - protein, 9 aa, Homo sapiens
LLSSVTAEL

SEQ ID NO: 11850 - protein, 9 aa, Homo sapiens
LLTDILVFL

SEQ ID NO: 11851 - protein, 9 aa, Homo sapiens
LLWPGAALL

SEQ ID NO: 11852 - protein, 9 aa, Homo sapiens
LLYHYWIAV

SEQ ID NO: 11853 - protein, 9 aa, Homo sapiens
LLYVNVIGL

SEQ ID NO: 11854 - protein, 9 aa, Homo sapiens
LLYYGVVTL

SEQ ID NO: 11855 - protein, 10 aa, Homo sapiens
LMVELLKVFV

SEQ ID NO: 11856 - protein, 10 aa, Homo sapiens
LNGFDDVHFL

SEQ ID NO: 11857 - protein, 9 aa, Homo sapiens
LPINGNGKQ

SEQ ID NO: 11858 - protein, 9 aa, Homo sapiens
LQCNPPPGL

SEQ ID NO: 11859 - protein, 9 aa, Homo sapiens
LSFPCSLKI

SEQ ID NO: 11860 - protein, 9 aa, Homo sapiens
LSLDALLTV

SEQ ID NO: 11861 - protein, 9 aa, Homo sapiens
LVLPVLVFL

SEQ ID NO: 11862 - protein, 9 aa, Homo sapiens
MMMALLVPL

SEQ ID NO: 11863 - protein, 11 aa, Homo sapiens
MMTFDPQDILL

SEQ ID NO: 11864 - protein, 11 aa, Homo sapiens
NIIEAINELLV

SEQ ID NO: 11865 - protein, 9 aa, Homo sapiens
NILDFVVVV

SEQ ID NO: 11866 - protein, 9 aa, Homo sapiens
NLANVVLLL

SEQ ID NO: 11867 - protein, 9 aa, Homo sapiens
NLFHYLTEV

SEQ ID NO: 11868 - protein, 9 aa, Homo sapiens
NLFKLEVRL

SEQ ID NO: 11869 - protein, 9 aa, Homo sapiens
NLFSREFRA

SEQ ID NO: 11870 - protein, 9 aa, Homo sapiens
NLLELFVQL

SEQ ID NO: 11871 - protein, 15 aa, Homo sapiens
NLLNHSSMFLDEAMN

SEQ ID NO: 11872 - protein, 10 aa, Homo sapiens
NLLSKVLIYL

SEQ ID NO: 11873 - protein, 11 aa, Homo sapiens
  misc_feature (10)..(10): Xaa can be any naturally occurring amino acid
NLMELLIMIXM

SEQ ID NO: 11874 - protein, 11 aa, Homo sapiens
NLMPQMKTLYL

SEQ ID NO: 11875 - protein, 8 aa, Homo sapiens
PINGNGKQ

SEQ ID NO: 11876 - protein, 8 aa, Homo sapiens
PLGYEIQL

SEQ ID NO: 11877 - protein, 9 aa, Homo sapiens
PLLDLHIEL

SEQ ID NO: 11878 - protein, 9 aa, Homo sapiens
PVEQYLGVP

SEQ ID NO: 11879 - protein, 8 aa, Homo sapiens
PYHWPLLV

SEQ ID NO: 11880 - protein, 15 aa, Homo sapiens
QIMDYLLCLCYSTLC

SEQ ID NO: 11881 - protein, 10 aa, Homo sapiens
QLIDYKILGL

SEQ ID NO: 11882 - protein, 9 aa, Homo sapiens
QLLDLMHTL

SEQ ID NO: 11883 - protein, 9 aa, Homo sapiens
QLLGLIQRV

SEQ ID NO: 11884 - protein, 9 aa, Homo sapiens
QLWFREFFL

SEQ ID NO: 11885 - protein, 9 aa, Homo sapiens
QLYSVDVTL

SEQ ID NO: 11886 - protein, 9 aa, Homo sapiens
QMFQYFITV

SEQ ID NO: 11887 - protein, 11 aa, Homo sapiens
QMMQNPQILAA

SEQ ID NO: 11888 - protein, 10 aa, Homo sapiens
RIADGLPVAV

SEQ ID NO: 11889 - protein, 9 aa, Homo sapiens
RIIDIWILL

SEQ ID NO: 11890 - protein, 9 aa, Homo sapiens
RKSLKIIYI

SEQ ID NO: 11891 - protein, 9 aa, Homo sapiens
RLASTLVQV

SEQ ID NO: 11892 - protein, 9 aa, Homo sapiens
RLFEVPHEL

SEQ ID NO: 11893 - protein, 11 aa, Homo sapiens
RLFEVPHELVA

SEQ ID NO: 11894 - protein, 10 aa, Homo sapiens
RLIDDMVAQV

SEQ ID NO: 11895 - protein, 10 aa, Homo sapiens
RLIDIFIINL

SEQ ID NO: 11896 - protein, 11 aa, Homo sapiens
RLIQGDQILSV

SEQ ID NO: 11897 - protein, 10 aa, Homo sapiens
RLLAETHYQL

SEQ ID NO: 11898 - protein, 18 aa, Homo sapiens
RLLEQGCTDFTVCYSTLC

SEQ ID NO: 11899 - protein, 11 aa, Homo sapiens
RLLEVNQQSLL

SEQ ID NO: 11900 - protein, 11 aa, Homo sapiens
RLLEVTNTIRV

SEQ ID NO: 11901 - protein, 10 aa, Homo sapiens
RLLILENILL

SEQ ID NO: 11902 - protein, 9 aa, Homo sapiens
RLLQAVALV

SEQ ID NO: 11903 - protein, 9 aa, Homo sapiens
RLLTVLPSL

SEQ ID NO: 11904 - protein, 9 aa, Homo sapiens
RLLYQLVFL

SEQ ID NO: 11905 - protein, 11 aa, Homo sapiens
RLPNRALLVNV

SEQ ID NO: 11906 - protein, 9 aa, Homo sapiens
RLYEITIEV

SEQ ID NO: 11907 - protein, 11 aa, Homo sapiens
RMGGFGSIIQL

SEQ ID NO: 11908 - protein, 9 aa, Homo sapiens
RMLYMIEQV

SEQ ID NO: 11909 - protein, 10 aa, Homo sapiens
RVLDFDPMAV

SEQ ID NO: 11910 - protein, 9 aa, Homo sapiens
SDPFTHLAP

SEQ ID NO: 11911 - protein, 11 aa, Homo sapiens
SIGKPSLFISV

SEQ ID NO: 11912 - protein, 9 aa, Homo sapiens
SIIDWLNSV

SEQ ID NO: 11913 - protein, 9 aa, Homo sapiens
SIISNLDEV

SEQ ID NO: 11914 - protein, 14 aa, Homo sapiens
SIKNYLQFLDEAMN

SEQ ID NO: 11915 - protein, 9 aa, Homo sapiens
SILPVILRL

SEQ ID NO: 11916 - protein, 9 aa, Homo sapiens
SILQTLILV

SEQ ID NO: 11917 - protein, 9 aa, Homo sapiens
SILSLLIKL

SEQ ID NO: 11918 - protein, 9 aa, Homo sapiens
SILSLVTKI

SEQ ID NO: 11919 - protein, 9 aa, Homo sapiens
SLAGFLLSV

SEQ ID NO: 11920 - protein, 9 aa, Homo sapiens
SLAPIIVYI

SEQ ID NO: 11921 - protein, 12 aa, Homo sapiens
SLASFIPAVNDL

SEQ ID NO: 11922 - protein, 9 aa, Homo sapiens
SLDPTLPSV

SEQ ID NO: 11923 - protein, 9 aa, Homo sapiens
SLDWQMVFL

SEQ ID NO: 11924 - protein, 15 aa, Homo sapiens
SLEENLPCICYSTLC

SEQ ID NO: 11925 - protein, 10 aa, Homo sapiens
SLFAQRLKTL

SEQ ID NO: 11926 - protein, 9 aa, Homo sapiens
SLIARLERL

SEQ ID NO: 11927 - protein, 9 aa, Homo sapiens
SLIDILVAL

SEQ ID NO: 11928 - protein, 10 aa, Homo sapiens
SLIEDLILLL

SEQ ID NO: 11929 - protein, 9 aa, Homo sapiens
SLIEVVIGL

SEQ ID NO: 11930 - protein, 15 aa, Homo sapiens
SLIEYCIELCYSTLC

SEQ ID NO: 11931 - protein, 9 aa, Homo sapiens
SLIKYFLFV

SEQ ID NO: 11932 - protein, 10 aa, Homo sapiens
SLIPEGPPQV

SEQ ID NO: 11933 - protein, 10 aa, Homo sapiens
SLISIKRLTL

SEQ ID NO: 11934 - protein, 9 aa, Homo sapiens
SLLDELLEV

SEQ ID NO: 11935 - protein, 12 aa, Homo sapiens
SLLDPRVGIRSV

SEQ ID NO: 11936 - protein, 9 aa, Homo sapiens
SLLDTLVLL

SEQ ID NO: 11937 - protein, 9 aa, Homo sapiens
SLLEAVSFL

SEQ ID NO: 11938 - protein, 15 aa, Homo sapiens
SLLEWCQEVCYSTLC

SEQ ID NO: 11939 - protein, 9 aa, Homo sapiens
SLLGFVATV

SEQ ID NO: 11940 - protein, 9 aa, Homo sapiens
SLLLLQLLL

SEQ ID NO: 11941 - protein, 10 aa, Homo sapiens
SLLPPQDPHL

SEQ ID NO: 11942 - protein, 9 aa, Homo sapiens
SLLQVLISI

SEQ ID NO: 11943 - protein, 9 aa, Homo sapiens
SLLSDIIAL

SEQ ID NO: 11944 - protein, 9 aa, Homo sapiens
SLLSHVIVA

SEQ ID NO: 11945 - protein, 10 aa, Homo sapiens
SLLSLLPLFL

SEQ ID NO: 11946 - protein, 11 aa, Homo sapiens
SLLSNDLKLNL

SEQ ID NO: 11947 - protein, 9 aa, Homo sapiens
SLLTAISEV

SEQ ID NO: 11948 - protein, 9 aa, Homo sapiens
SLMALILFL

SEQ ID NO: 11949 - protein, 9 aa, Homo sapiens
SLMDLTLLL

SEQ ID NO: 11950 - protein, 12 aa, Homo sapiens
SLMDPNKFLLLV

SEQ ID NO: 11951 - protein, 9 aa, Homo sapiens
SLMEILYTL

SEQ ID NO: 11952 - protein, 9 aa, Homo sapiens
SLMLVSTVL

SEQ ID NO: 11953 - protein, 9 aa, Homo sapiens
SLQEFLAAL

SEQ ID NO: 11954 - protein, 9 aa, Homo sapiens
SLQELLIQV

SEQ ID NO: 11955 - protein, 15 aa, Homo sapiens
SLSTCIPAICYSTLC

SEQ ID NO: 11956 - protein, 9 aa, Homo sapiens
SLSTVFVVL

SEQ ID NO: 11957 - protein, 9 aa, Homo sapiens
SLVDASWEL

SEQ ID NO: 11958 - protein, 9 aa, Homo sapiens
SLVELLVQL

SEQ ID NO: 11959 - protein, 9 aa, Homo sapiens
SLVGLLLYL

SEQ ID NO: 11960 - protein, 9 aa, Homo sapiens
SLVHINIFL

SEQ ID NO: 11961 - protein, 15 aa, Homo sapiens
SLVYLCYTVCYSTLC

SEQ ID NO: 11962 - protein, 9 aa, Homo sapiens
SLWGTHVVV

SEQ ID NO: 11963 - protein, 9 aa, Homo sapiens
SLYHVESTV

SEQ ID NO: 11964 - protein, 12 aa, Homo sapiens
SLYNDDRNLLRI

SEQ ID NO: 11965 - protein, 9 aa, Homo sapiens
SLYPSAPFL

SEQ ID NO: 11966 - protein, 9 aa, Homo sapiens
SMLLEIIFL

SEQ ID NO: 11967 - protein, 9 aa, Homo sapiens
SMLTLPLSL

SEQ ID NO: 11968 - protein, 9 aa, Homo sapiens
SMMALLVQL

SEQ ID NO: 11969 - protein, 9 aa, Homo sapiens
SPPAILVTV

SEQ ID NO: 11970 - protein, 10 aa, Homo sapiens
SQFQQEFPSL

SEQ ID NO: 11971 - protein, 11 aa, Homo sapiens
SQLDISDPYKV

SEQ ID NO: 11972 - protein, 11 aa, Homo sapiens
SQLDISEPYKV

SEQ ID NO: 11973 - protein, 10 aa, Homo sapiens
SQYDYILPQV

SEQ ID NO: 11974 - protein, 10 aa, Homo sapiens
SVAPFALPTV

SEQ ID NO: 11975 - protein, 9 aa, Homo sapiens
SVFAGVVGV

SEQ ID NO: 11976 - protein, 9 aa, Homo sapiens
SVLDLLVQL

SEQ ID NO: 11977 - protein, 9 aa, Homo sapiens
SVLDLVVAL

SEQ ID NO: 11978 - protein, 11 aa, Homo sapiens
TLADLRVLFGI

SEQ ID NO: 11979 - protein, 9 aa, Homo sapiens
TLAELHISL

SEQ ID NO: 11980 - protein, 15 aa, Homo sapiens
TLCDLYETLCYSTLC

SEQ ID NO: 11981 - protein, 11 aa, Homo sapiens
TLFHDPWKLLI

SEQ ID NO: 11982 - protein, 9 aa, Homo sapiens
TLIAAILYL

SEQ ID NO: 11983 - protein, 11 aa, Homo sapiens
TLIGLSIKVKL

SEQ ID NO: 11984 - protein, 11 aa, Homo sapiens
TLLDASEKLKL

SEQ ID NO: 11985 - protein, 9 aa, Homo sapiens
TLLGVTVTV

SEQ ID NO: 11986 - protein, 9 aa, Homo sapiens
TLLHFLVEI

SEQ ID NO: 11987 - protein, 9 aa, Homo sapiens
TLLHLAVSL

SEQ ID NO: 11988 - protein, 10 aa, Homo sapiens
TLLPGEGPFL

SEQ ID NO: 11989 - protein, 9 aa, Homo sapiens
TLLPTLYEI

SEQ ID NO: 11990 - protein, 9 aa, Homo sapiens
TLMEEVLLL

SEQ ID NO: 11991 - protein, 11 aa, Homo sapiens
TLMEEVLLLGL

SEQ ID NO: 11992 - protein, 9 aa, Homo sapiens
TLQPTLVAV

SEQ ID NO: 11993 - protein, 9 aa, Homo sapiens
TLSNLWIFL

SEQ ID NO: 11994 - protein, 9 aa, Homo sapiens
TLSPLLLFL

SEQ ID NO: 11995 - protein, 15 aa, Homo sapiens
TLVTWLQCVCYSTLC

SEQ ID NO: 11996 - protein, 9 aa, Homo sapiens
TLWQIVINI

SEQ ID NO: 11997 - protein, 9 aa, Homo sapiens
TLWRGPVVV

SEQ ID NO: 11998 - protein, 9 aa, Homo sapiens
TLWYKIFTT

SEQ ID NO: 11999 - protein, 9 aa, Homo sapiens
TLWYVPLSL

SEQ ID NO: 12000 - protein, 9 aa, Homo sapiens
TMLELLLRL

SEQ ID NO: 12001 - protein, 9 aa, Homo sapiens
TMLSLEFHL

SEQ ID NO: 12002 - protein, 12 aa, Homo sapiens
TRDGFDLDLTYV

SEQ ID NO: 12003 - protein, 10 aa, Homo sapiens
TYKDPNNLAF

SEQ ID NO: 12004 - protein, 9 aa, Homo sapiens
VALFKGKQI

SEQ ID NO: 12005 - protein, 12 aa, Homo sapiens
VFGGIGDPVTCL

SEQ ID NO: 12006 - protein, 9 aa, Homo sapiens
VIFDLPTTV

SEQ ID NO: 12007 - protein, 11 aa, Homo sapiens
VILDIPLLFET

SEQ ID NO: 12008 - protein, 9 aa, Homo sapiens
VLEDLEVTV

SEQ ID NO: 12009 - protein, 9 aa, Homo sapiens
VLFELKLLL

SEQ ID NO: 12010 - protein, 9 aa, Homo sapiens
VLFESQFSV

SEQ ID NO: 12011 - protein, 9 aa, Homo sapiens
VLFEVAWEV

SEQ ID NO: 12012 - protein, 9 aa, Homo sapiens
VLFGFVPET

SEQ ID NO: 12013 - protein, 11 aa, Homo sapiens
VLFGWPSLVFV

SEQ ID NO: 12014 - protein, 11 aa, Homo sapiens
VLFSVADRLRL

SEQ ID NO: 12015 - protein, 10 aa, Homo sapiens
VLLEYHIAYL

SEQ ID NO: 12016 - protein, 11 aa, Homo sapiens
VLLFERELHSV

SEQ ID NO: 12017 - protein, 9 aa, Homo sapiens
VLLHVSVLL

SEQ ID NO: 12018 - protein, 9 aa, Homo sapiens
VLLRVLILL

SEQ ID NO: 12019 - protein, 12 aa, Homo sapiens
VLLSEETKRIFL

SEQ ID NO: 12020 - protein, 10 aa, Homo sapiens
VLLTDILVFL

SEQ ID NO: 12021 - protein, 11 aa, Homo sapiens
VLMEDRLTNRL

SEQ ID NO: 12022 - protein, 9 aa, Homo sapiens
VLMGQLYVV

SEQ ID NO: 12023 - protein, 12 aa, Homo sapiens
VLQEFGRIDILV

SEQ ID NO: 12024 - protein, 9 aa, Homo sapiens
VLVSFAYKV

SEQ ID NO: 12025 - protein, 11 aa, Homo sapiens
VLWDLVDRIGI

SEQ ID NO: 12026 - protein, 11 aa, Homo sapiens
VMFKKIKSFEV

SEQ ID NO: 12027 - protein, 9 aa, Homo sapiens
VTEGVIVPE

SEQ ID NO: 12028 - protein, 11 aa, Homo sapiens
VWRHGSYGSAD

SEQ ID NO: 12029 - protein, 9 aa, Homo sapiens
WIILCYIWL

SEQ ID NO: 12030 - protein, 9 aa, Homo sapiens
WLLCFIFTV

SEQ ID NO: 12031 - protein, 9 aa, Homo sapiens
WLPEVMILV

SEQ ID NO: 12032 - protein, 9 aa, Homo sapiens
WPEVLLLLT

SEQ ID NO: 12033 - protein, 10 aa, Homo sapiens
WVSLYCVLSK

SEQ ID NO: 12034 - protein, 9 aa, Homo sapiens
YIAGFFLTV

SEQ ID NO: 12035 - protein, 9 aa, Homo sapiens
YIALKLVAV

SEQ ID NO: 12036 - protein, 12 aa, Homo sapiens
YIMDWMDEMKVL

SEQ ID NO: 12037 - protein, 11 aa, Homo sapiens
YLAGLHANIAV

SEQ ID NO: 12038 - protein, 9 aa, Homo sapiens
YLAIVWPVV

SEQ ID NO: 12039 - protein, 9 aa, Homo sapiens
YLATFALKV

SEQ ID NO: 12040 - protein, 9 aa, Homo sapiens
YLDFRNNSL

SEQ ID NO: 12041 - protein, 9 aa, Homo sapiens
YLDIINLFL

SEQ ID NO: 12042 - protein, 9 aa, Homo sapiens
YLEEILVRV

SEQ ID NO: 12043 - protein, 10 aa, Homo sapiens
YLFDIQLPNI

SEQ ID NO: 12044 - protein, 10 aa, Homo sapiens
YLFEIRDWRL

SEQ ID NO: 12045 - protein, 10 aa, Homo sapiens
YLFGKEMYQV

SEQ ID NO: 12046 - protein, 8 aa, Homo sapiens
YLFKVVLI

SEQ ID NO: 12047 - protein, 9 aa, Homo sapiens
YLFTIINSL

SEQ ID NO: 12048 - protein, 9 aa, Homo sapiens
YLGIVELLV

SEQ ID NO: 12049 - protein, 9 aa, Homo sapiens
YLHEDIPGL

SEQ ID NO: 12050 - protein, 10 aa, Homo sapiens
YLIDRDPTYF

SEQ ID NO: 12051 - protein, 10 aa, Homo sapiens
YLILHLISTV

SEQ ID NO: 12052 - protein, 10 aa, Homo sapiens
YLINFEIRSL

SEQ ID NO: 12053 - protein, 11 aa, Homo sapiens
YLIPFTGIVGL

SEQ ID NO: 12054 - protein, 10 aa, Homo sapiens
YLIQSVPAEL

SEQ ID NO: 12055 - protein, 9 aa, Homo sapiens
YLISELEAA

SEQ ID NO: 12056 - protein, 10 aa, Homo sapiens
YLLDMPLWYL

SEQ ID NO: 12057 - protein, 10 aa, Homo sapiens
YLLEEILDKV

SEQ ID NO: 12058 - protein, 9 aa, Homo sapiens
YLLEKSRIV

SEQ ID NO: 12059 - protein, 10 aa, Homo sapiens
YLMNLNIMTV

SEQ ID NO: 12060 - protein, 10 aa, Homo sapiens
YLMQNWEHVL

SEQ ID NO: 12061 - protein, 9 aa, Homo sapiens
YLNLIELFL

SEQ ID NO: 12062 - protein, 9 aa, Homo sapiens
YLPVKIEQV

SEQ ID NO: 12063 - protein, 11 aa, Homo sapiens
YLQDQHLLLTV

SEQ ID NO: 12064 - protein, 12 aa, Homo sapiens
YLSDEGHYWVGL

SEQ ID NO: 12065 - protein, 11 aa, Homo sapiens
YLSELSEHVKL

SEQ ID NO: 12066 - protein, 9 aa, Homo sapiens
YLSGIIVTL

SEQ ID NO: 12067 - protein, 10 aa, Homo sapiens
YLSHNGIEVI

SEQ ID NO: 12068 - protein, 9 aa, Homo sapiens
YLTSQLPPL

SEQ ID NO: 12069 - protein, 9 aa, Homo sapiens
YLTYILLHL

SEQ ID NO: 12070 - protein, 9 aa, Homo sapiens
YLVELSSLL

SEQ ID NO: 12071 - protein, 9 aa, Homo sapiens
YLVNDIYEL

SEQ ID NO: 12072 - protein, 10 aa, Homo sapiens
YLWEHIFEGL

SEQ ID NO: 12073 - protein, 9 aa, Homo sapiens
YLYEHNFAF

SEQ ID NO: 12074 - protein, 10 aa, Homo sapiens
YLYPIKNLEM

SEQ ID NO: 12075 - protein, 9 aa, Homo sapiens
YMAPEVVEA

SEQ ID NO: 12076 - protein, 9 aa, Homo sapiens
YMFEAREFL

SEQ ID NO: 12077 - protein, 12 aa, Homo sapiens
  misc_feature (11)..(11): Xaa can be any naturally occurring amino acid
YMFEEVPIVIXM

SEQ ID NO: 12078 - protein, 10 aa, Homo sapiens
YMIDNVILLI

SEQ ID NO: 12079 - protein, 11 aa, Homo sapiens
YQFDSALLPAV

SEQ ID NO: 12080 - protein, 9 aa, Homo sapiens
YQSELELRV

SEQ ID NO: 12081 - protein, 12 aa, Homo sapiens
YTIGKEIIDLVL

SEQ ID NO: 12082 - protein, 11 aa, Homo sapiens
YVIAYIRDLAL

SEQ ID NO: 12083 - protein, 9 aa, Homo sapiens
YVLDLAAKV

SEQ ID NO: 12084 - protein, 10 aa, Homo sapiens
YVLEDLEVTV

SEQ ID NO: 12085 - protein, 9 aa, Homo sapiens
YVLKYLFEV

SEQ ID NO: 12086 - protein, 10 aa, Homo sapiens
YVMEYRELFL

SEQ ID NO: 12087 - protein, 12 aa, Homo sapiens
YVNLPINGNGKQ

SEQ ID NO: 12088 - protein, 10 aa, Homo sapiens
SAAGIGILTV

SEQ ID NO: 12089 - protein, 10 aa, Homo sapiens
GVAGIGILTG

SEQ ID NO: 12090 - protein, 9 aa, Homo sapiens
GALNSVLTL

SEQ ID NO: 12091 - protein, 10 aa, Homo sapiens
GVAGIGILTG

SEQ ID NO: 12092 - protein, 10 aa, Homo sapiens
SAAGIGILTV

SEQ ID NO: 12093 - protein, 11 aa, Artificial Sequence
  Epitope
RYLYHRVDVIF

SEQ ID NO: 12094 - protein, 10 aa, Artificial Sequence
  epitope
RYLYHRVDVI

SEQ ID NO: 12095 - protein, 10 aa, Artificial Sequence
  epitope
YLYHRVDVIF

SEQ ID NO: 12096 - protein, 11 aa, Artificial Sequence
  epitope
YLYHRVDVIFC

SEQ ID NO: 12097 - protein, 11 aa, Artificial Sequence
  epitope
FRYLYHRVDVI

SEQ ID NO: 12098 - protein, 9 aa, Artificial Sequence
  epitope
YLYHRVDVI

SEQ ID NO: 12099 - protein, 9 aa, Artificial Sequence
  epitope
RYLYHRVDV

SEQ ID NO: 12100 - protein, 11 aa, Artificial Sequence
  epitope
HIDLLFHSPRA

SEQ ID NO: 12101 - protein, 10 aa, Artificial Sequence
  epitope
EDFVFSKYCH

SEQ ID NO: 12102 - protein, 11 aa, Artificial Sequence
  epitope
QESCEKNDSLS

SEQ ID NO: 12103 - protein, 11 aa, Artificial Sequence
  epitope
SEFFSCLADQH

SEQ ID NO: 12104 - protein, 11 aa, Artificial Sequence
  epitope
ANRFSAVNSLI

SEQ ID NO: 12105 - protein, 11 aa, Artificial Sequence
  epitope
KKQIEHQVLSC

SEQ ID NO: 12106 - protein, 11 aa, Artificial Sequence
  epitope
VEILPFFYLGS

SEQ ID NO: 12107 - protein, 10 aa, Artificial Sequence
  epitope
ASSEQMDVAF

SEQ ID NO: 12108 - protein, 10 aa, Artificial Sequence
  epitope
SSCFDYVMHF

SEQ ID NO: 12109 - protein, 11 aa, Artificial Sequence
  epitope
AFVANLFNTYL

SEQ ID NO: 12110 - protein, 11 aa, Artificial Sequence
  epitope
RCSFSAHQCMH

SEQ ID NO: 12111 - protein, 11 aa, Artificial Sequence
  epitope
RNLLSVGHQLF

SEQ ID NO: 12112 - protein, 11 aa, Artificial Sequence
  epitope
SRRPQAAPVLT

SEQ ID NO: 12113 - protein, 11 aa, Artificial Sequence
  epitope
SDYETFKNFFV

SEQ ID NO: 12114 - protein, 11 aa, Artificial Sequence
  epitope
KDGFLELKCVL

SEQ ID NO: 12115 - protein, 11 aa, Artificial Sequence
  epitope
SKYCHRALLLP

SEQ ID NO: 12116 - protein, 11 aa, Artificial Sequence
  epitope
VKDITDSYNAN

SEQ ID NO: 12117 - protein, 10 aa, Artificial Sequence
  epitope
AKEYFRYLYH

SEQ ID NO: 12118 - protein, 10 aa, Artificial Sequence
  epitope
FRYLYHRVDV

SEQ ID NO: 12119 - protein, 11 aa, Artificial Sequence
  epitope
AKEYFRYLYHR

SEQ ID NO: 12120 - protein, 8 aa, Artificial Sequence
  epitope
FYLYHRVD

SEQ ID NO: 12121 - protein, 9 aa, Artificial Sequence
  epitope
AKEYFRYLY

SEQ ID NO: 12122 - protein, 11 aa, Artificial Sequence
  epitope
EYFRYLYHRVD

SEQ ID NO: 12123 - protein, 11 aa, Artificial Sequence
  epitope
PTAKEYFRYLY

SEQ ID NO: 12124 - protein, 10 aa, Artificial Sequence
  epitope
YFRYLYHRVD

SEQ ID NO: 12125 - protein, 11 aa, Artificial Sequence
  epitope
TAKEYFRYLYH

SEQ ID NO: 12126 - protein, 10 aa, Artificial Sequence
  epitope
EYFRYLYHRV

SEQ ID NO: 12127 - protein, 11 aa, Artificial Sequence
  epitope
KEYFRYLYHRV

SEQ ID NO: 12128 - protein, 9 aa, Artificial Sequence
  epitope
KEYFRYLYH

SEQ ID NO: 12129 - protein, 9 aa, Artificial Sequence
  epitope
EYFRYLYHR

SEQ ID NO: 12130 - protein, 10 aa, Artificial Sequence
  epitope
PTAKEYFRYL

SEQ ID NO: 12131 - protein, 10 aa, Artificial Sequence
  epitope
TAKEYFRYLY

SEQ ID NO: 12132 - protein, 11 aa, Artificial Sequence
  epitope
ELPTAKEYFRY

SEQ ID NO: 12133 - protein, 11 aa, Artificial Sequence
  epitope
LPTAKEYFRYL

SEQ ID NO: 12134 - protein, 11 aa, Artificial Sequence
  epitope
YFRYLYHRVDV

SEQ ID NO: 12135 - protein, 10 aa, Artificial Sequence
  epitope
KEYFRYLYHR

SEQ ID NO: 12136 - protein, 9 aa, Artificial Sequence
  epitope
YFRYLYHRV

SEQ ID NO: 12137 - protein, 9 aa, Artificial Sequence
  epitope
PTAKEYFRY

SEQ ID NO: 12138 - DNA, 28 bp, Artificial Sequence
  primer
agctcctcgagatggcgacgggttcaag

SEQ ID NO: 12139 - DNA, 48 bp, Artificial Sequence
  primer
ccaccgcgagacctcttgctccgcactttacaagctgtgagagacaca

SEQ ID NO: 12140 - DNA, 46 bp, Artificial Sequence
  primer
ccaccgcgagacctcttgctccgagctgtgagagacacatcagagc

SEQ ID NO: 12141 - DNA, 18 bp, Artificial Sequence
  primer
cggagcaagaggtctcgc

SEQ ID NO: 12142 - DNA, 30 bp, Artificial Sequence
  primer
ttgacctcgagtcatcttggtggcagagcc

SEQ ID NO: 12143 - DNA, 15 bp, Artificial Sequence
  primer
caggagggctcggca

SEQ ID NO: 12144 - DNA, 15 bp, Artificial Sequence
  primer
ggaccctccgcatcc

SEQ ID NO: 12145 - DNA, 36 bp, Artificial Sequence
  primer
  misc_feature (16)..(21): n is a, c, g, or t
caggagggctcggcannnnnnggatgcggagggtcc

SEQ ID NO: 12146 - DNA, 75 bp, Artificial Sequence
  primer
aatgatacggcgaccaccgagatctacactctttccctacacgacgctcttccgatctggcctgctttgtttgcc

SEQ ID NO: 12147 - DNA, 53 bp, Artificial Sequence
  primer
gtgactggagttcagacgtgtgctcttccgatctcctccaccaccgctacctc

SEQ ID NO: 12148 - DNA, 58 bp, Artificial Sequence
  primer
caagcagaagacggcatacgagatgtgactggagttcagacgtgtgctcttccgatct

SEQ ID NO: 12149 - DNA, 27 bp, Artificial Sequence
  Cytomegalovirus (CMV)
aatctggttccgatggttgccacagta

SEQ ID NO: 12150 - protein, 9 aa, Artificial Sequence
  Cytomegalovirus (CMV)
NLVPMVATV

SEQ ID NO: 12151 - DNA, 27 bp, Artificial Sequence
  Epstein-Barr Virus (EBV)
ggcctgtgtacgttggtggctatgctg

SEQ ID NO: 12152 - protein, 9 aa, Artificial Sequence
  Epstein-Barr Virus (EBV)
GLCTLVAML

SEQ ID NO: 12153 - protein, 10 aa, Homo sapiens
VMNILLQYVV

SEQ ID NO: 12154 - DNA, 30 bp, Homo sapiens
gttatgaacattttgctgcagtacgtggtg

SEQ ID NO: 12155 - DNA, 42 bp, Homo sapiens
acagtctacggggcattcgaccctctgctggccgtagcagat

SEQ ID NO: 12156 - protein, 14 aa, Homo sapiens
TVYGAFDPLLAVAD

SEQ ID NO: 12157 - DNA, 39 bp, Triticum aestivum
tcaggggagggcagcttccagccgtctcaagaaaatccg

SEQ ID NO: 12158 - protein, 13 aa, Triticum aestivum
SGEGSFQPSQENP

SEQ ID NO: 12159 - DNA, 27 bp, Triticum aestivum
cccttcccccagcccgagctgccctac

SEQ ID NO: 12160 - protein, 9 aa, Triticum aestivum
PFPQPELPY

SEQ ID NO: 12161 - DNA, 27 bp, Homo sapiens
atggtatgggagagcggatgtactgtg

SEQ ID NO: 12162 - protein, 9 aa, Homo sapiens
MVWESGCTV

SEQ ID NO: 12163 - DNA, 27 bp, Homo sapiens
gtcctctttggtcttgggttcgcaatc

SEQ ID NO: 12164 - protein, 9 aa, Homo sapiens
VLFGLGFAI

SEQ ID NO: 12165 - DNA, 27 bp, Homo sapiens
cacctcgtcgaggcattgtacctcgtg

SEQ ID NO: 12166 - protein, 9 aa, Homo sapiens
HLVEALYLV

SEQ ID NO: 12167 - DNA, 45 bp, Homo sapiens
agccacctggtggaggccctgtacctggtgtgcggcgagaggggc

SEQ ID NO: 12168 - protein, 15 aa, Homo sapiens
SHLVEALYLVCGERG

SEQ ID NO: 12169 - DNA, 30 bp, Human immunodeficiency virus
aaaagatggataatcctgggattaaataaa

SEQ ID NO: 12170 - protein, 10 aa, Human immunodeficiency virus
KRWIILGLNK

SEQ ID NO: 12171 - DNA, 48 bp, Listeria monocytogenes
aacgagaagtacgcccaggcctaccccaacgtgagcgccaagatcgac

SEQ ID NO: 12172 - protein, 16 aa, Listeria monocytogenes
NEKYAQAYPNVSAKID

SEQ ID NO: 12173 - DNA, 30 bp, Homo sapiens
gaggccgccggcatcggcatcctgaccgtg

SEQ ID NO: 12174 - protein, 10 aa, Homo sapiens
EAAGIGILTV

SEQ ID NO: 12175 - DNA, 30 bp, Artificial Sequence
  Synthetic
gagctggccggcatcggcatcctgaccgtg

SEQ ID NO: 12176 - protein, 10 aa, Artificial Sequence
  Synthetic
ELAGIGILTV

SEQ ID NO: 12177 - DNA, 27 bp, Homo sapiens
agcctgctgatgtggatcacccagtgc

SEQ ID NO: 12178 - protein, 9 aa, Homo sapiens
SLLMWITQC

SEQ ID NO: 12179 - DNA, 27 bp, Artificial Sequence
  synthetic
tccctgctgatgtggatcacccaggtg

SEQ ID NO: 12180 - protein, 9 aa, Artificial Sequence
  Synthetic
SLLMWITQV

SEQ ID NO: 12181 - DNA, 24 bp, Gallus gallus
agcatcatcaacttcgagaagctg

SEQ ID NO: 12182 - protein, 8 aa, Gallus gallus
SIINFEKL

SEQ ID NO: 12183 - DNA, 51 bp, Gallus gallus
ataagccaggccgttcatgctgcacatgcagaaataaacgaggctggcaga

SEQ ID NO: 12184 - protein, 17 aa, Gallus gallus
ISQAVHAAHAEINEAGR

SEQ ID NO: 12185 - DNA, 30 bp, Homo sapiens
gcactctggggtcctgatccggctgcggct

SEQ ID NO: 12186 - protein, 10 aa, Homo sapiens
ALWGPDPAAA

SEQ ID NO: 12187 - DNA, 51 bp, Homo sapiens
ggcgccggcagcctgcagcccctggccctggagggcagcctgcagaagagg

SEQ ID NO: 12188 - protein, 17 aa, Homo sapiens
GAGSLQPLALEGSLQKR

SEQ ID NO: 12189 - DNA, 54 bp, Homo sapiens
ggaagtttgcagccattggctctggaagggagcctgcaaaaacgcggcattgta

SEQ ID NO: 12190 - protein, 18 aa, Homo sapiens
GSLQPLALEGSLQKRGIV

SEQ ID NO: 12191 - DNA, 54 bp, Artificial Sequence
  synthetic
ggaagtttgcagccattggcttgggaagggagcctgcaaaaacgcggcattgta

SEQ ID NO: 12192 - protein, 18 aa, Artificial Sequence
  synthetic
GSLQPLAWEGSLQKRGIV

SEQ ID NO: 12193 - DNA, 27 bp, Human immunodeficiency virus
tcattatataatacagtagcaaccctc

SEQ ID NO: 12194 - protein, 9 aa, Human immunodeficiency virus
SLYNTVATL

SEQ ID NO: 12195 - protein, 9 aa, Artificial Sequence
  peptide
TIDQLCKTF

What is claimed is:

1. A signaling and antigen-presenting bifunctional receptor (SABR) comprising:

an antigen presenting domain comprising a binding domain of a major histocompatibility complex (MHC) molecule, a peptide epitope covalently linked to the binding domain of the MHC molecule for extracellular presentation of the peptide epitope to a first cell expressing at least one antigen receptor, and a transmembrane domain;

one or more linkers; and a signal transduction domain fused to the antigen presenting domain, wherein the SABR is made by a method comprising expressing, in a second cell that is an isolated cell, a nucleic acid sequence encoding the antigen presenting domain, the signal transduction domain, and the one or more linkers, and wherein the peptide epitope is synthesized and cloned, from pooled single stranded oligonucleotide libraries, into the nucleic acid sequence, wherein the transmembrane domain comprises a transmembrane domain from one or more of 4-1BB (CD137), CD28, CD27, DAP10, ICOS, OX40, PD1, CTLA4, TIM3, CD3zeta, Notch, synNotch, CD79A, CD79B, CD72, CD22, CD5, CD19, CD45, IL2, IL4, EPO, GM-CSF, JAK-STAT, CCL10, a G protein coupled receptor, a receptor of the TNF Receptor superfamily, a NK cell receptor, a Fc receptor, a toll-like receptor, a RIG-I-like receptor, a NOD-like receptor, or a MHC molecule, and wherein the signal transduction domain comprises an intracellular signaling domain of CD137, CD27, DAP10, ICOS, OX40, PD1, CTLA4, TIM3, an IL2, an IL4, an EPO, a GM-CSF, JAK-STAT, a CCL10, a G protein coupled receptor, or a receptor of the TNF Receptor superfamily, or a fragment thereof.

2. The SABR of claim 1, wherein the antigen presenting domain comprises the MHC.

3. The SABR of claim 1, wherein the MHC comprises a Class I MHC, and
wherein the MHC comprises HLA-A*0201 or HLA-B*2705.

4. The SABR of claim 1, wherein the MHC comprises a Class II MHC.

5. The SABR of claim 1, wherein the second cell is a reporter cell, and
wherein the reporter cell provides a detectable marker upon binding of the SABR to the antigen receptor.

6. The SABR of claim 5, wherein the reporter cell comprises NFAT-GFP-Jurkat cells.

7. The SABR of claim 5, wherein the first cell is a T cell comprising TCR.

8. The SABR of claim 5, wherein the first cell expresses an orphan TCR.

9. The SABR of claim 1, wherein the oligonucleotide libraries encode pathogen epitopes.

10. A signaling and antigen-presenting bifunctional receptor (SABR) comprising:
an antigen presenting domain comprising a major histocompatibility complex (MHC) molecule, a peptide epitope covalently linked to the MHC molecule for extracellular presentation of the peptide epitope to a first cell expressing at least one antigen receptor, and a transmembrane domain;
one or more linkers; and
a signal transduction domain fused to the antigen presenting domain,
wherein the SABR is made by a method comprising expressing, in a second cell that is an isolated cell, a nucleic acid sequence encoding the antigen presenting domain and the signal transduction domain, wherein the MHC molecule is class I or class II,
wherein the peptide epitope is synthesized and cloned, from pooled single stranded oligonucleotide libraries, into the nucleic acid sequence,
wherein the peptide epitope comprises a cancer peptide epitope,
wherein the transmembrane domain comprises a transmembrane domain from one or more of 4-1BB (CD137), CD28, CD27, DAP10, ICOS, OX40, PD1, CTLA4, TIM3, CD3zeta, Notch, synNotch, CD79A, CD79B, CD72, CD22, CD5, CD19, CD45, IL2, IL4, EPO, GM-CSF, JAK-STAT, CCL10, a G protein coupled receptor, a receptor of the TNF Receptor superfamily, a NK cell receptor, a Fc receptor, a toll-like receptor, a RIG-I-like receptor, a NOD-like receptor, or an MHC molecule, and
wherein the signal transduction domain comprises an intracellular signaling domain of CD137, CD27, DAP10, ICOS, OX40, PD1, CTLA4, TIM3, an IL2, an IL4, an EPO, a GM-CSF, JAK-STAT, a CCL10, a G protein coupled receptor, or a receptor of the TNF Receptor superfamily, or a fragment thereof.

* * * * *